US008410336B2

(12) United States Patent
Lutfiyya

(10) Patent No.: US 8,410,336 B2

(45) Date of Patent: Apr. 2, 2013

(54) TRANSGENIC PLANTS WITH ENHANCED AGRONOMIC TRAITS

(75) Inventor: Linda L. Lutfiyya, St. Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 13/299,402

(22) Filed: Nov. 18, 2011

(65) Prior Publication Data

US 2012/0066787 A1 Mar. 15, 2012

Related U.S. Application Data

(63) Continuation of application No. 12/316,385, filed on Dec. 11, 2008, now abandoned.

(60) Provisional application No. 61/013,179, filed on Dec. 12, 2007.

(51) Int. Cl.

| | |
|---|---|
| ***A01H 5/00*** | (2006.01) |
| ***A01H 1/00*** | (2006.01) |
| ***A01H 5/10*** | (2006.01) |
| ***C12N 15/82*** | (2006.01) |

(52) U.S. Cl. ........ 800/284; 800/295; 800/266; 435/468; 435/419

(58) Field of Classification Search ........................ None
See application file for complete search history.

(56) References Cited

U.S. PATENT DOCUMENTS

| | | | | |
|---|---|---|---|---|
| 6,781,034 | B2 | 8/2004 | Palatnik et al. | |
| 2006/0179511 | A1 * | 8/2006 | Chomet et al. ................ | 800/278 |
| 2009/0165165 | A1 | 6/2009 | Madappa et al. | |

OTHER PUBLICATIONS

Friedberg (Brief. Bioinformatics (2006) 7: 225-242).*

Guo et al (PNAS 2004 (101)25,9205-9210).*

"U.S. Appl. No. 12/316,385, Non Final Office Action mailed Aug. 25, 2011", 13 pgs.

"U.S. Appl. No. 12/316,385, Response filed Jul. 22, 2011 to Restriction Requirement mailed May 5, 2011", 7 pgs.

"U.S. Appl. No. 12/316,385, Restriction Requirement mailed May 5, 2011", 9 pgs.

Fillat, Maria F, et al., "Isolation and overexpression in *Escherichia coli* of the flavodoxin gene from *Anabaena* PCC 7119", Biochem J. 280, (1991), 187-191.

Guo, et al., "Protein Tolerance to Random Amino Acid Change", PNAS, 101(25), 101: 9205-9210, (Jun. 2004), 9205-9210.

Avonce, Nelson, et al., "Additional File 2: alignment of about 60 TPS domains spanning over about 420 amino acid residues", Insights on the evolution of trehalose biosynthesis, BMC Ecol. Biol., 6:109 (2006), (Dec. 19, 2006), 4 pgs.

Avonce, Nelson, et al., "Additional File 4: alignment of about 60 TPP domains spanning over about 230 amino acid residues", Insights on the evolution of trehalose biosynthesis; BMC Ecol. Biol., 6:109 (2006), (Dec. 19, 2006), 3 pgs.

Avonce, Nelson, et al., "Insights on the evolution of trehalose biosynthesis", BMC Ecol. Biol., 6:109 (2006), (Dec. 19, 2006), 15 pgs.

Bouche, N., et al., "*Arabidopsis* Gene Knockout: Phenotypes Wanted", Curr Opin Plant Biol. Apr. 2001;4(2):111-7 (abstract only), (Apr. 4, 2001), 1 pg.

Eastmond, P. J., et al., "Abstract: Trehalose-6-phosphate synthase 1, which catalyses the first step in trehalose synthesis, is essential for *Arabidopsis* embryo maturation", Plant J., 29:225 (2002), 1 pg.

Glinski, Mirko, et al., "Differential Multisite Phosphorylation of the Trehalose-6-phosphate Synthase Gene Family in *Arabidopsis thaliana*", Mol. & Cell. Proteomics, 4:1614 (2005), 1614-1625.

Greene, Elizabeth A., et al., "Spectrum of Chemically Induced Mutations From a Large-Scale Reverse-Genetic Screen in *Arabidopsis*", Genetics 164: 731-740 (Jun. 2003), 731-740.

Lu, C., et al., "A High-Throughput Screen for Genes from Castor that Boost Hydroxy Fatty Acid Accumulation in Seed Oils of Transgenic *Arabidoopsis*", Plant J. Mar. 2006;45(5):847-56 (abstract only), 1 pg.

Rama Devi, S., et al., "A Novel High-Throughput Genetic Screen for Stress-Responsive Mutants of *Arabidopsis thaliana* Reveals New Loci Involving Stress Responses", Plant J. Aug. 2006;47(4):652-63 (abstract only), 1 pg.

Skandalis, A., et al., "Enzymatic Properties of Rat DNA Polymerase Beta Mutants Obtained by Randomized Mutagenesis", Nucleic Acids Res. Jun. 1, 2001;29(11):2418-26 (abstract only), 1 pg.

Stoop, A. A., et al., "High-Density Mutagenesis by Combined DNA Shuffling and Phage Display to Assign Essential Amino Acid Residues in Protein-Protein Interactions: Application to Study Structure-Function of Plasminogen Activation Inhibitor 1 (PAI-I)", J Mol Biol. Sep. 1, 2000: 301(5):1135-47 (abstract only), 1 pg.

Takahashi, Y., et al., "A High-Throughput Screen of Cell-Death-Inducing Factors in *Nicotiana bentharniana* Identifies a Novel MAPKK that Mediates INF1-induced Cell Death Signaling and non-Host Resistance to *Pseudomonas cichorii*", Plant J. Mar. 2007;49(6):1030-40 (abstract only), 1 pg.

Vogel, Guido, et al., "Trehalose metabolism in *Arabidopsis*: occurrence of trehalose and molecular cloning and characterization of trehalose-6-phosphate synthase homologues", J. Exp. Botany, 52:1817, (Sep. 2001), 1817-1826.

Yeh, T. C., et al., "A Dual Role for the Kinase-like Domain of the Tyrosine Kinase Tyk2 in Interferon-alpha Signaling", Proc Nati Acad Sci USA Aug. 1, 2000;97(16):8991-6 (abstract only), 1 pg.

*Primary Examiner* — Anne Kubelik
*Assistant Examiner* — Lee A Visone
(74) *Attorney, Agent, or Firm* — Schwegman Lundberg & Woessner, P.A.

(57) ABSTRACT

This invention provides transgenic plant cells with recombinant DNA for expression of proteins that are useful for imparting enhanced agronomic trait(s) to transgenic crop plants. This invention also provides transgenic plants and progeny seed comprising the transgenic plant cells where the plants are selected for having an enhanced trait selected from the group of traits consisting of enhanced water use efficiency, enhanced cold tolerance, increased yield, enhanced nitrogen use efficiency, enhanced seed protein and enhanced seed oil. Also disclosed are methods for manufacturing transgenic seed and plants with enhanced traits.

15 Claims, 4 Drawing Sheets

TRANSGENIC PLANTS WITH ENHANCED AGRONOMIC TRAITS

CROSS REFERENCE TO RELATED APPLICATIONS

This application is a continuation under 35 U.S.C. §120 of U.S. application Ser. No. 12/316,385 filed on Dec. 11, 2008 (pending), which is incorporated by reference in its entirety including sequence listing and Pfam tables. Application Ser. No. 12/316,385 claims benefit under 35 USC §119(e) of U.S. provisional application Ser. No. 61/013,179, filed Dec. 12, 2007, which is also incorporated herein by reference in its entirety.

INCORPORATION OF SEQUENCE LISTING

A computer readable form (CRF) of the sequence listing file named "55579C_seqListing.txt", which is 5,484,279 bytes (measured in MS-WINDOWS), was created on Nov. 15, 2011, filed herewith, and are incorporated herein by reference in its entirety.

INCORPORATION Of LARGE TABLE

A large table containing a folder "pfamdir" on CD-Rs were previously submitted in the parent U.S. application Ser. No. 12/316,385 on Dec. 11, 2008. The content of which are incorporated herein by reference in their entirety. Folder "pfamdir" contains 10 Pfam Hidden Markov Models. The CD-Rs were created on Dec. 8, 2008, having a total size of 864,256 bytes (measured in MS-WINDOWS).

FIELD OF THE INVENTION

Disclosed herein are recombinant DNA useful for providing enhanced traits to transgenic plants, seeds, pollen, plant cells and plant nuclei of such transgenic plants, methods of making and using such recombinant DNA, plants, seeds, pollen, plant cells and plant nuclei. Also disclosed are methods of producing hybrid corn seed comprising such recombinant DNA.

SUMMARY OF THE INVENTION

An aspect of this invention provides recombinant DNA constructs comprising polynucleotides characterized by an encoded protein having amino acids representing a protein family domain module as described in Table 10. Another aspect of this invention provides recombinant DNA constructs comprising polynucleotides characterized by an encoded protein with an amino acid sequence that is at least 90% identical to a corresponding consensus sequence defined in table 8. Yet another aspect of this invention provides recombinant DNA constructs comprising polynucleotides characterized by reference to SEQ ID NO:1-10 and the cognate proteins with amino acid sequences having reference to SEQ ID NO:11-20. The recombinant DNA constructs are useful for providing enhanced traits when stably integrated into the chromosomes and expressed in the nuclei of transgenic plants cells. In most aspects of the invention the recombinant DNA constructs, when expressed in a plant cell, provide for expression of cognate proteins. In particular aspects of the invention the recombinant DNA constructs for expressing cognate proteins are characterized by cognate amino acid sequence that have at least 95% identity over at least 95% of the length of a reference sequence in the group of SEQ ID NOs: 12-16, and 20 when the amino acid sequence is aligned to the reference sequence. In particularly specific embodiments of the invention, the recombinant DNA constructs comprise polynucleotide stacks characterized by cognate proteins having amino acid sequences that have at least 95% identity over at least 95% of the length of reference sequences 13-14 when the amino acid sequences are aligned to the reference sequences. In some aspects of the invention, i.e. the recombinant DNA constructs are characterized as being constructed with sense-oriented and anti-sense-oriented polynucleotides from SEQ ID NOs: 1, and 7-9 which, when expressed in a plant cell, provide for the suppression of cognate proteins having amino acid sequences that have at least 95% identity over at least 95% of the length of a reference sequence in the group consisting of SEQ ID NOs: 11 and 17-19.

In practical aspects of this invention the recombinant DNA constructs of the invention are stably integrated into the chromosome of a plant cell nucleus.

This invention also provides transgenic plant cells comprising the stably integrated recombinant DNA constructs of the invention, transgenic plants and seeds comprising a plurality of such transgenic plant cells and transgenic pollen of such plants. Such transgenic plants are selected from a population of transgenic plants regenerated from plant cells transformed with recombinant DNA constructs by screening transgenic plants for an enhanced trait as compared to control plants. The enhanced trait is one or more of enhanced water use efficiency, enhanced cold tolerance, increased yield, enhanced nitrogen use efficiency, enhanced seed protein and enhanced seed oil.

In another aspect of the invention the plant cells, plants, seeds, and pollen further comprise DNA expressing a protein that provides tolerance from exposure to an herbicide applied at levels that are lethal to a wild type plant cell.

This invention also provides methods for manufacturing non-natural, transgenic seed that can be used to produce a crop of transgenic plants with an enhanced trait resulting from expression of a stably-integrated recombinant DNA construct. More specifically, the method comprises (a) screening a population of plants for an enhanced trait and a recombinant DNA construct, where individual plants in the population can exhibit the trait at a level less than, essentially the same as or greater than the level that the trait is exhibited in control plants, (b) selecting from the population one or more plants that exhibit the trait at a level greater than the level that said trait is exhibited in control plants, (c) collecting seed from a selected plant, (d) verifying that the recombinant DNA is stably integrated in said selected plants, (e) analyzing tissue of a selected plant to determine the production or suppression of a protein having the function of a protein encoded by nucleotides in a sequence of one of SEQ ID NOs:1-10. In one aspect of the invention, the plants in the population further comprise DNA expressing a protein that provides tolerance to exposure to a herbicide applied at levels that are lethal to wild type plant cells and the selecting is affected by treating the population with the herbicide, e.g. a glyphosate, dicamba, or glufosinate compound. In another aspect of the invention the plants are selected by identifying plants with the enhanced trait. The methods are especially useful for manufacturing corn, soybean, cotton, canola, alfalfa, wheat, rice, sugarcane or sugar beet seed.

Another aspect of the invention provides a method of producing hybrid corn seed comprising acquiring hybrid corn seed from a herbicide tolerant corn plant which also has stably-integrated, recombinant DNA construct comprising a promoter that is (a) functional in plant cells and (b) is operably linked to DNA that encodes or suppresses a protein having the function of a protein encoded by nucleotides in a sequence of one of SEQ ID NOs:1-10. The methods further comprise producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Another aspect of the invention provides a method of selecting a plant comprising plant cells of the invention by using an immunoreactive antibody to detect the presence or absence of protein expressed or suppressed by recombinant DNA in seed or plant tissue. Yet another aspect of the invention provides anti-counterfeit milled seed having, as an indication of origin, plant cells of this invention.

Still other aspects of this invention relate to transgenic plants with enhanced water use efficiency or enhanced nitrogen use efficiency. For instance, this invention provides methods of growing a corn, cotton, soybean, or canola crop without irrigation water comprising planting seed having plant cells of the invention which are selected for enhanced water use efficiency. Alternatively methods comprise applying reduced irrigation water, e.g. providing up to 300 millimeters of ground water during the production of a corn crop. This invention also provides methods of growing a corn, cotton, soybean or canola crop without added nitrogen fertilizer comprising planting seed having plant cells of the invention which are selected for enhanced nitrogen use efficiency.

Another aspect of the invention provides a mixture comprising plants cells and an antibody to a protein produced in the cells where the protein has an amino acid sequence that has at least 95% identity over at least 95% of the length of a reference sequence selected from the group consisting of SEQ ID NO: 11-20 when the sequence is aligned to the reference sequence.

DETAILED DESCRIPTION OF THE INVENTION

Figure 1:
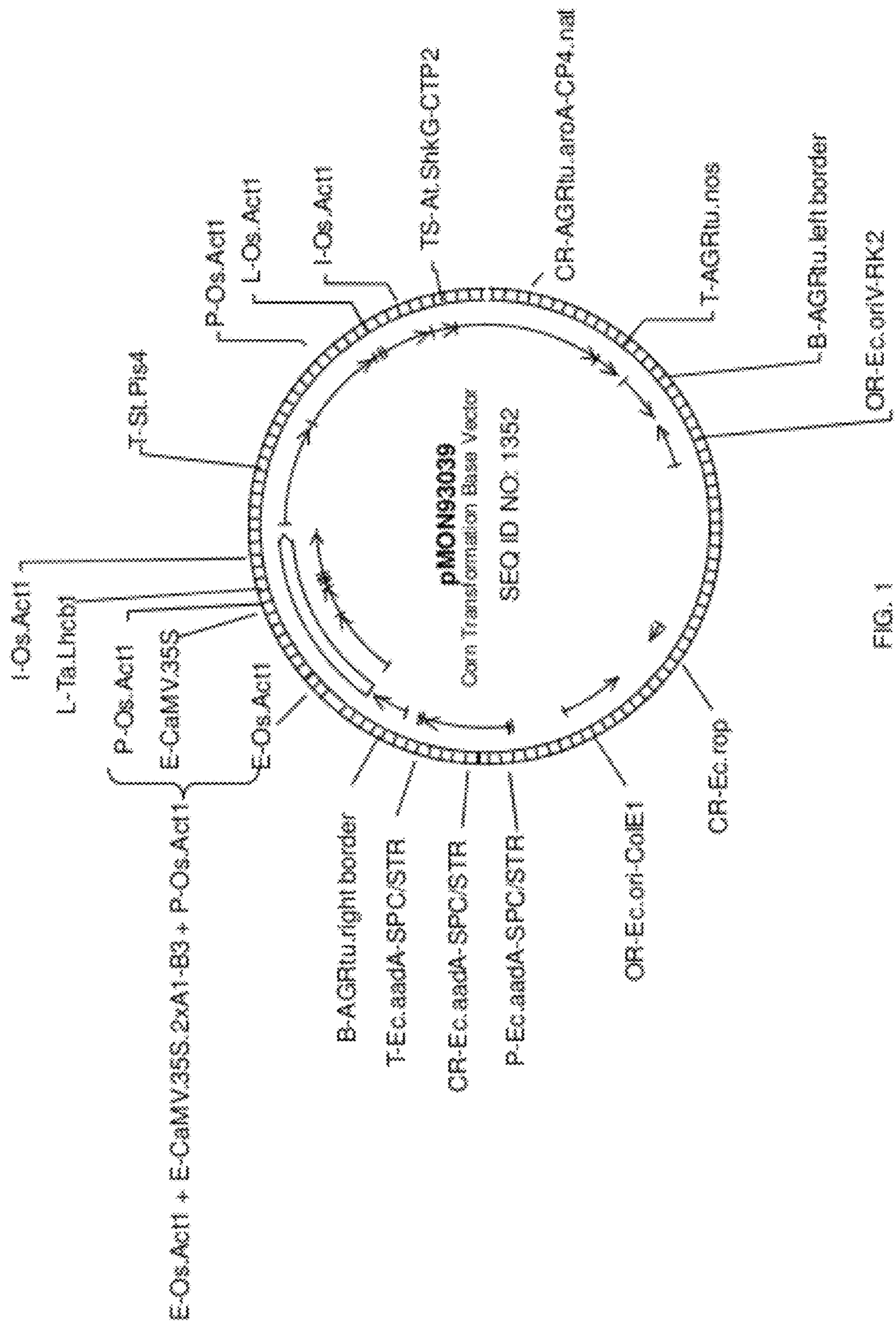
FIGS. 1-4 are plasmid maps.

In the attached sequence listing:

SEQ ID NO:1-10 are nucleotide sequences of the coding strand of DNA for "genes" used in the recombinant DNA imparting an enhanced trait in plant cells, i.e. each represents a coding sequence for a protein;

SEQ ID NO: 11-20 are amino acid sequences of the cognate protein of the "genes" with nucleotide coding sequences 1-10;

SEQ ID NO: 21-1351 are amino acid sequences of homologous proteins;

SEQ ID NO: 1352 is a nucleotide sequence of a base plasmid vector useful for corn transformation;

SEQ ID NO: 1353 is a nucleotide sequence of a base plasmid vector useful for soybean and canola transformation;

SEQ ID NO: 1354 is a nucleotide sequence of a base plasmid vector useful for cotton transformation;

SEQ ID NO: 1355 is a nucleotide sequence of a base plasmid vector useful for co-transformation to produce gene stacks in corn;

SEQ ID NO: 1356-1358 are consensus sequences. Table 8 lists the protein SEQ ID NOs and their corresponding consensus SEQ ID NOs.

As used herein a "plant cell" means a plant cell that is transformed with stably-integrated, non-natural, recombinant DNA, e.g. by *Agrobacterium*-mediated transformation or by bombardment using microparticles coated with recombinant DNA or other means. A plant cell of this invention can be an originally-transformed plant cell that exists as a microorganism or as a progeny plant cell that is regenerated into differentiated tissue, e.g. into a transgenic plant with stably-integrated, non-natural recombinant DNA, or seed or pollen derived from a progeny transgenic plant.

As used herein a "transgenic plant" means a plant whose genome has been altered by the stable integration of recombinant DNA. A transgenic plant includes a plant regenerated from an originally-transformed plant cell and progeny transgenic plants from later generations or crosses of a transformed plant.

As used herein "recombinant DNA" means DNA which has been a genetically engineered and constructed outside of a cell including DNA containing naturally occurring DNA or cDNA or synthetic DNA.

As used herein "consensus sequence" means an artificial sequence of amino acids in a conserved region of an alignment of amino acid sequences of homologous proteins, e.g. as determined by a CLUSTALW alignment of amino acid sequence of homolog proteins.

As used herein a "homolog" means a protein in a group of proteins that perform the same biological function, e.g. proteins that belong to the same Pfam protein family and that provide a common enhanced trait in transgenic plants of this invention. Homologs are expressed by homologous genes. With reference to homologous genes, homologs include orthologs, i.e. genes expressed in different species that evolved from a common ancestral genes by speciation and encode proteins retain the same function, but do not include paralogs, i.e. genes that are related by duplication but have evolved to encode proteins with different functions. Homologous genes include naturally occurring alleles and artificially-created variants. Degeneracy of the genetic code provides the possibility to substitute at least one base of the protein encoding sequence of a gene with a different base without causing the amino acid sequence of the polypeptide produced from the gene to be changed. When optimally aligned, homolog proteins have at least 60% identity, more preferably about 65% or higher, more preferably about 70% or higher, more preferably at least 75%, more preferably at least 80%, more preferably at least 85%, and even more preferably at least 90% identity over the full length of a protein identified as being associated with imparting an enhanced trait when expressed in plant cells. In one aspect of the invention homolog proteins have an amino acid sequence that has at least 90% identity to a consensus amino acid sequence of proteins and homologs disclosed herein.

Homologs are identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. Because a protein hit with the best E-value for a particular organism may not necessarily be an ortholog, i.e. have the same function, or be the only ortholog, a reciprocal query is used to filter hit sequences with significant E-values for ortholog identification. The reciprocal query entails search of the significant hits against a database of amino acid sequences from the base organism that are similar to the sequence of the query protein. A hit can be identified as an ortholog, when the reciprocal query's best hit is the query protein itself or a protein encoded by a duplicated gene after speciation. A further aspect of the homologs encoded by DNA useful in the transgenic plants of the invention are those proteins that differ from a disclosed protein as the result of deletion or insertion of one or more amino acids in a native sequence.

"Percent identity" describes the extent to which the sequences of DNA or protein segments are invariant throughout a window of alignment of sequences, for example nucleotide sequences or amino acid sequences. An "identity fraction" for a sequence aligned with a reference sequence is the number of identical components which are shared by the sequences, divided by the length of the alignment not including gaps introduced by the alignment algorithm. "Percent identity" ("% identity") is the identity fraction times 100. Percent identity is calculated over the aligned length preferably using a local alignment algorithm, such as BLASTp. As used herein, sequences are "aligned" when the alignment produced by BLASTp has a minimal e-value.

"Pfam" is a large collection of multiple sequence alignments and hidden Markov models covering many common protein families, e.g. Pfam version 19.0 (December 2005) contains alignments and models for 8183 protein families and is based on the Swissprot 47.0 and SP-TrEMBL 30.0 protein sequence databases. See S. R. Eddy, "Profile Hidden Markov Models", *Bioinformatics* 14:755-763, 1998. The Pfam database is currently maintained and updated by the Pfam Consortium. The alignments represent some evolutionary conserved structure that has implications for the protein's function. Profile hidden Markov models (profile HMMs) built from the protein family alignments are useful for automatically recognizing that a new protein belongs to an existing protein family even if the homology by alignment appears to be low.

Protein domains are identified by querying the amino acid sequence of a protein against Hidden Markov Models which characterize protein family domains ("Pfam domains") using HMMER software, which is available from the Pfam Consortium. The HMMER software is also disclosed in patent application publication US 2008/0148432 A1 incorporated herein by reference. A protein domain meeting the gathering cutoff for the alignment of a particular Pfam domain is considered to contain the Pfam domain.

A "Pfam domain module" is a representation of Pfam domains in a protein, in order from N terminus to C terminus. In a Pfam domain module individual Pfam domains are separated by double colons "::". The order and copy number of the Pfam domains from N to C terminus are attributes of a Pfam domain module. Although the copy number of repetitive domains is important, varying copy number often enables a similar function. Thus, a Pfam domain module with multiple copies of a domain should define an equivalent Pfam domain module with variance in the number of multiple copies. A Pfam domain module is not specific for distance between adjacent domains, but contemplates natural distances and variations in distance that provide equivalent function. The Pfam database contains both narrowly- and broadly-defined domains, leading to identification of overlapping domains on some proteins. A Pfam domain module is characterized by non-overlapping domains. Where there is overlap, the domain having a function that is more closely associated with the function of the protein (based on the E value of the Pfam match) is selected.

Once one DNA is identified as encoding a protein which imparts an enhanced trait when expressed in transgenic plants, other DNA encoding proteins with the same Pfam domain module are identified by querying the amino acid sequence of protein encoded by candidate DNA against the Hidden Markov Models which characterizes the Pfam domains using HMMER software. Candidate proteins meeting the same Pfam domain module are in the protein family and have cognate DNA that is useful in constructing recombinant DNA for the use in the plant cells of this invention. Hidden Markov Model databases for use with HMMER software in identifying DNA expressing protein with a common Pfam domain module for recombinant DNA in the plant cells of this invention are included in the large table incorporated into this application.

The HMMER software and Pfam databases (version 19.0) were used to identify known domains in the proteins corresponding to amino acid sequence of SEQ ID NO: 11 through SEQ ID NO: 16 and SEQ ID NO: 20. All DNA encoding proteins that have scores higher than the gathering cutoff disclosed in Table 11 by Pfam analysis disclosed herein can be used in recombinant DNA of the plant cells of this invention, e.g. for selecting transgenic plants having enhanced agronomic traits. The relevant Pfams modules for use in this invention, as more specifically disclosed below, are Cu-oxidase_3::Cu-oxidase::Cu-oxidase_2, Flavodoxin_1, Glyco_transf_20::Trehalose_PPase, Aminotran_1_2, and B3::Auxin_resp::AUX_IAA, for which the databases are included in the appended computer listing.

As used herein "promoter" means regulatory DNA for initializing transcription. A "plant promoter" is a promoter capable of initiating transcription in plant cells whether or not its origin is a plant cell, e.g. is it well known that *Agrobacterium* promoters are functional in plant cells. Thus, plant promoters include promoter DNA obtained from plants, plant viruses and bacteria such as *Agrobacterium* and *Bradyrhizobium* bacteria. Examples of promoters under developmental control include promoters that preferentially initiate transcription in certain tissues, such as leaves, roots, or seeds. Such promoters are referred to as "tissue preferred". Promoters that initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions.

As used herein "operably linked" means the association of two or more DNA fragments in a recombinant DNA construct so that the function of one, e.g. protein-encoding DNA, is controlled by the other, e.g. a promoter.

As used herein "expressed" means produced, e.g. a protein is expressed in a plant cell when its cognate DNA is transcribed to mRNA that is translated to the protein.

As used herein "suppressed" means decreased, e.g. a protein is suppressed in a plant cell when there is a decrease in the amount and/or activity of the protein in the plant cell. The presence or activity of the protein can be decreased by any amount up to and including a total loss of protein expression and/or activity.

As used herein a "control plant" means a plant that does not contain the recombinant DNA that imparts an enhanced trait. A control plant is used to identify and select a transgenic plant that has an enhanced trait. A suitable control plant can be a non-transgenic plant of the parental line used to generate a transgenic plant, i.e. devoid of recombinant DNA. A suitable control plant may in some cases be a progeny of a hemizygous transgenic plant line that does not contain the recombinant DNA, known as a negative segregant.

As used herein an "enhanced trait" means a characteristic of a transgenic plant that includes, but is not limited to, an enhance agronomic trait characterized by enhanced plant morphology, physiology, growth and development, yield, nutritional enhancement, disease or pest resistance, or environmental or chemical tolerance. In more specific aspects of this invention enhanced trait is selected from group of enhanced traits consisting of enhanced water use efficiency, enhanced cold tolerance, increased yield, enhanced nitrogen use efficiency, enhanced seed protein and enhanced seed oil. In an important aspect of the invention the enhanced trait is enhanced yield including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), ear number, seed number per ear, seed size, composition of seed (starch, oil, protein) and characteristics of seed fill.

Increased yield of a transgenic plant of the present invention can be measured in a number of ways, including test weight, seed number per plant, seed weight, seed number per unit area (i.e. seeds, or weight of seeds, per acre), bushels per acre, tons per acre, or kilo per hectare. For example, corn yield may be measured as production of shelled corn kernels per unit of production area, for example in bushels per acre or metric tons per hectare, often reported on a moisture adjusted basis, for example at 15.5 percent moisture. Increased yield may result from improved utilization of key biochemical compounds, such as nitrogen, phosphorous and carbohydrate, or from improved responses to environmental stresses, such as cold, heat, drought, salt, and attack by pests or pathogens. Recombinant DNA used in this invention can also be used to provide plants having improved growth and development, and ultimately increased yield, as the result of modified expression of plant growth regulators or modification of cell cycle or photosynthesis pathways. Also of interest is the generation of transgenic plants that demonstrate enhanced yield with respect to a seed component that may or may not correspond to an increase in overall plant yield. Such properties include enhancements in seed oil, seed molecules such as protein and starch, oil components as may be manifest by an alterations in the ratios of seed components.

Recombinant DNA constructs are assembled using methods well known to persons of ordinary skill in the art and typically comprise a promoter operably linked to DNA, the expression of which provides the enhanced agronomic trait. Other construct components may include additional regulatory elements, such as 5' leaders and introns for enhancing transcription, 3' untranslated regions (such as polyadenylation signals and sites), DNA for transit or signal peptides.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens* and the CaMV35S promoters from the cauliflower mosaic virus as disclosed in U.S. Pat. Nos. 5,164,316 and 5,322,938. Useful promoters derived from plant genes are found in U.S. Pat. No. 5,641,876 which discloses a rice actin promoter, U.S. Pat. No. 7,151,204 which discloses a maize chloroplast aldolase promoter and a maize aldolase (FDA) promoter, and US Patent Application Publication 2003/0131377 A1 which discloses a maize nicotianamine synthase promoter. These and numerous other promoters that function in plant cells are known to those skilled in the art and available for use in recombinant polynucleotides of the present invention to provide for expression of desired genes in transgenic plant cells.

Furthermore, the promoters may be altered to contain multiple "enhancer sequences" to assist in elevating gene expression. Such enhancers are known in the art. By including an enhancer sequence with such constructs, the expression of the selected protein may be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene. See also US Patent Application Publication 2002/0192813A1 which discloses 5', 3' and intron elements useful in the design of effective plant expression vectors.

In other aspects of the invention, sufficient expression in plant seed tissues is desired to affect improvements in seed composition. Exemplary promoters for use for seed composition modification include promoters from seed genes such as napin as disclosed in U.S. Pat. No. 5,420,034, maize L3 oleosin as disclosed in U.S. Pat. No. 6,433,252), zein Z27 as disclosed by Russell et al. (1997) *Transgenic Res.* 6(2):157-166), globulin 1 as disclosed by Belanger et al (1991) *Genetics* 129:863-872), glutelin 1 as disclosed by Russell (1997) supra), and peroxiredoxin antioxidant (Per1) as disclosed by Stacy et al. (1996) *Plant Mol Biol.* 31(6):1205-1216.

Recombinant DNA constructs useful in this invention will also generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627; 3' elements from plant genes such as wheat (*Triticum aesevitum*) heat shock protein 17 (Hsp17 3'), a wheat ubiquitin gene, a wheat fructose-1,6-biphosphatase gene, a rice glutelin gene, a rice lactate dehydrogenase gene and a rice beta-tubulin gene, all of which are disclosed in US Patent Application Publication 2002/0192813

A1; and the pea (*Pisum sativum*) ribulose biphosphate carboxylase gene (rbs 3'), and 3' elements from the genes within the host plant.

Constructs and vectors may also include a transit peptide for targeting of a gene to a plant organelle, particularly to a chloroplast, leucoplast or other plastid organelle. For descriptions of the use of chloroplast transit peptides see U.S. Pat. No. 5,188,642 and U.S. Pat. No. 5,728,925. For description of the transit peptide region of an *Arabidopsis* EPSPS gene useful in the present invention, see Klee, H. J. et al (*MGG* (1987) 210:437-442).

Recombinant DNA constructs for gene suppression can be designed for any of a number the well-known methods for suppressing transcription of a gene, the accumulation of the mRNA corresponding to that gene or preventing translation of the transcript into protein. Posttranscriptional gene suppression can be practically effected by transcription of RNA that forms double-stranded RNA (dsRNA) having homology to mRNA produced from a gene targeted for suppression.

Gene suppression can also be achieved by insertion mutations created by transposable elements may also prevent gene function. For example, in many dicot plants, transformation with the T-DNA of *Agrobacterium* may be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants may be screened with polynucleotides encoding the polypeptide of interest to detect mutated plants having an insertion in the gene encoding the polypeptide of interest.

Transgenic plants may comprise a stack of one or more polynucleotides disclosed herein resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene, and co-transformation of genes into a single plant cell. Co-transformation of genes can be carried out using single transformation vectors comprising multiple genes or genes carried separately on multiple vectors.

Transgenic plants comprising or derived from plant cells of this invention transformed with recombinant DNA can be further enhanced with stacked traits, e.g. a crop plant having an enhanced trait resulting from expression of DNA disclosed herein in combination with herbicide and/or pest resistance traits. For example, genes of the current invention can be stacked with other traits of agronomic interest, such as a trait providing herbicide resistance, or insect resistance, such as using a gene from *Bacillus thuringensis* to provide resistance against lepidopteran, coliopteran, homopteran, hemiopteran, and other insects. Herbicides for which transgenic plant tolerance has been demonstrated and the method of the present invention can be applied include, but are not limited to, glyphosate, dicamba, glufosinate, sulfonylurea, bromoxynil and norflurazon herbicides. Polynucleotide molecules encoding proteins involved in herbicide tolerance are well-known in the art and include, but are not limited to, a polynucleotide molecule encoding 5-enolpyruvylshikimate-3-phosphate synthase (EPSPS) disclosed in U.S. Pat. Nos. 5,094,945; 5,627,061; 5,633,435 and 6,040,497 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in US Patent Application Publication 2003/0083480 A1 also for imparting glyphosate tolerance; dicamba monooxygenase disclosed in US Patent Application Publication 2003/0135879 A1 for imparting dicamba tolerance; a polynucleotide molecule encoding bromoxynil nitrilase (Bxn) disclosed in U.S. Pat. No. 4,810,648 for imparting bromoxynil tolerance; a polynucleotide molecule encoding phytoene desaturase (crtI) described in Misawa et al, (1993) *Plant J.* 4:833-840 and in Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for imparting tolerance to sulfonylurea herbicides; polynucleotide molecules known as bar genes disclosed in DeBlock, et al. (1987) *EMBO J.* 6:2513-2519 for imparting glufosinate and bialaphos tolerance; polynucleotide molecules disclosed in US Patent Application Publication 2003/010609 A1 for imparting N-amino methyl phosphonic acid tolerance; polynucleotide molecules disclosed in U.S. Pat. No. 6,107,549 for impartinig pyridine herbicide resistance; molecules and methods for imparting tolerance to multiple herbicides such as glyphosate, atrazine, ALS inhibitors, isoxoflutole and glufosinate herbicides are disclosed in U.S. Pat. No. 6,376,754 and US Patent Application Publication 2002/0112260. Molecules and methods for imparting insect/nematode/virus resistance are disclosed in U.S. Pat. Nos. 5,250,515; 5,880,275; 6,506,599; 5,986,175 and US Patent Application Publication 2003/0150017 A1.

Plant Cell Transformation Methods

Numerous methods for transforming chromosomes in a plant cell nucleus with recombinant DNA are known in the art and are used in methods of preparing a transgenic plant cell nucleus cell, and plant. Two effective methods for such transformation are *Agrobacterium*-mediated transformation and microprojectile bombardment. Microprojectile bombardment methods are illustrated in U.S. Pat. Nos. 5,015,580 (soybean); 5,550,318 (corn); 5,538,880 (corn); 5,914,451 (soybean); 6,160,208 (corn); 6,399,861 (corn); 6,153,812 (wheat) and 6,365,807 (rice) and *Agrobacterium*-mediated transformation is described in U.S. Pat. Nos. 5,159,135 (cotton); 5,824,877 (soybean); 5,463,174 (canola); 5,591,616 (corn); 5,846,797 (cotton); 6,384,301 (soybean), 7,026,528 (wheat) and 6,329,571 (rice), US Patent Application Publication 2004/0087030 A1 (cotton), and US Patent Application Publication 2001/0042257 A1 (sugar beet), all of which are incorporated herein by reference for enabling the production of transgenic plants. Transformation of plant material is practiced in tissue culture on a nutrient media, i.e. a mixture of nutrients that will allow cells to grow in vitro. Recipient cell targets include, but are not limited to, meristem cells, hypocotyls, calli, immature embryos and gametic cells such as microspores, pollen, sperm and egg cells. Callus may be initiated from tissue sources including, but not limited to, immature embryos, hypocotyls, seedling apical meristems, microspores and the like. Cells containing a transgenic nucleus are grown into transgenic plants.

In addition to direct transformation of a plant material with a recombinant DNA, a transgenic plant cell nucleus can be prepared by crossing a first plant having cells with a transgenic nucleus with recombinant DNA with a second plant lacking the transgenic nucleus. For example, recombinant DNA can be introduced into a nucleus from a first plant line that is amenable to transformation to transgenic nucleus in cells that are grown into a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line In the practice of transformation DNA is typically introduced into only a small percentage of target plant cells in any one transformation experiment. Marker genes are used to provide an efficient system for identification of those cells that are stably transformed by receiving and integrating a recombinant DNA molecule into their genomes. Preferred marker genes provide selective markers which confer resistance to a selective agent, such as an antibiotic or a herbicide. Any of the herbicides to which plants of this invention may be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin and paromomycin (val), hygromycin B (aph IV), spectinomycin (aadA) and gentamycin (aac3 and aacC4) or resistance to herbicides such as glufosinate (bar or pat), dicamba (DMO) and glyphosate (aroA or EPSPS). Examples of such selectable markers are illustrated in U.S. Pat. Nos. 5,550,318; 5,633,435; 5,780,708 and 6,118,047. Markers which provide an ability to visually screen transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to the selective agent, or plant cells that have been scored positive in a screening assay, may be cultured in regeneration media and allowed to mature into plants. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2}s^{-1}$ of light, prior to transfer to a greenhouse or growth chamber for maturation. Plants are regenerated from about 6 weeks to 10 months after a transformant is identified, depending on the initial tissue, and plant species. Plants may be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of enhanced agronomic trait.

Transgenic Plants and Seeds

Transgenic plants derived from transgenic plant cells having a transgenic nucleus of this invention are grown to generate transgenic plants having an enhanced trait as compared to a control plant and produce transgenic seed and haploid pollen of this invention. Such plants with enhanced traits are identified by selection of transformed plants or progeny seed for the enhanced trait. For efficiency a selection method is designed to evaluate multiple transgenic plants (events) comprising the recombinant DNA, for example multiple plants from 2 to 20 or more transgenic events. Transgenic plants grown from transgenic seed provided herein demonstrate improved agronomic traits that contribute to increased yield or other trait that provides increased plant value, including, for example, improved seed quality. Of particular interest are plants having enhanced water use efficiency, enhanced cold tolerance, increased yield, enhanced nitrogen use efficiency, enhanced seed protein and enhanced seed oil.

Table 1 provides a list of protein encoding DNA ("genes") that are useful as recombinant DNA for production of transgenic plants with enhanced agronomic trait, the elements of Table 1 are described by reference to:

"PEP SEQ ID NO" identifies an amino acid sequence from SEQ ID NO: 11 to 20.

"NUC SEQ ID NO" identifies a DNA sequence from SEQ ID NO:1 to 10.

"Gene ID" refers to an arbitrary identifier.

"Gene Name" denotes a common name for protein encoded by the recombinant DNA.

"Annotation" refers to a description of the top hit protein obtained from an amino acid sequence query of each PEP SEQ ID NO to GENBANK database of the National Center for Biotechnology Information (ncbi).

TABLE 1

| NUC SEQ ID NO | PEP SEQ ID NO | Gene ID | Gene Name | Annotation |
|---|---|---|---|---|
| 1 | 11 | Mnom000034 | Corn ZmLac | gb\|AAX83113.1\| laccase 1 [*Zea mays*] |
| 2 | 12 | Mnom000037 | *Anabaena* FLD | gb\|AAB20462.1\| flavodoxin [*Anabaena*] |
| 3 | 13 | Mnom000048 | Corn TPS1 | gb\|EAY98715.1\| hypothetical protein OsI_019948 [*Oryza sativa* (*indica* cultivar-group)] |
| 4 | 14 | Mnom000049 | Corn TPP1 | gb\|EAY75823.1\| hypothetical protein OsI_003670 [*Oryza sativa* (*indica* cultivar-group)] |
| 5 | 15 | Mnom000067 | *Lycopersicon* AlaT | gb\|AAZ43369.1\| AlaT1 [*Vitis vinifera*] |
| 6 | 16 | Mnom000068 | *Lycopersicon* AlaT | gb\|AAZ43369.1\| AlaT1 [*Vitis vinifera*] |

TABLE 1-continued

| NUC SEQ ID NO | PEP SEQ ID NO | Gene ID | Gene Name | Annotation |
|---|---|---|---|---|
| 7 | 17 | Mnom000090 | Corn ZmGS3 | gb\|ABC84855.1\| grain length and weight protein [*Oryza sativa* (*indica* cultivar-group)] |
| 8 | 18 | Mnom000091 | Corn ZmGS3 | gb\|ABC84855.1\| grain length and weight protein [*Oryza sativa* (*indica* cultivar-group)] |
| 9 | 19 | Mnom000092 | Corn ZmBB | gb\|EAZ25768.1\| hypothetical protein OsJ_009251 [*Oryza sativa* (*japonica* cultivar-group)] |
| 10 | 20 | Mnom000095 | Corn OSJNBa0064D 20.11 Protein | ref\|NP_001052879.1\| Os04g0442000 [*Oryza sativa* (*japonica* cultivar-group)] [Mendel G471-like ner] |

Selection Methods for Transgenic Plants with Enhanced Agronomic Trait

Within a population of transgenic plants each regenerated from a plant cell having a nucleus with recombinant DNA many plants that survive to fertile transgenic plants that produce seeds and progeny plants will not exhibit an enhanced agronomic trait. Selection from the population is necessary to identify one or more transgenic plant cells having a transgenic nucleus that can provide plants with the enhanced trait. Transgenic plants having enhanced traits are selected from populations of plants regenerated or derived from plant cells transformed as described herein by evaluating the plants in a variety of assays to detect an enhanced trait, e.g. enhanced water use efficiency, enhanced cold tolerance, increased yield, enhanced nitrogen use efficiency, enhanced seed protein and enhanced seed oil. These assays also may take many forms including, but not limited to, direct screening for the trait in a greenhouse or field trial or by screening for a surrogate trait. Such analyses can be directed to detecting changes in the chemical composition, biomass, physiological properties, morphology of the plant. Changes in chemical compositions such as nutritional composition of grain can be detected by analysis of the seed composition and content of protein, free amino acids, oil, free fatty acids, starch or tocopherols. Changes in biomass characteristics can be made on greenhouse or field grown plants and can include plant height, stem diameter, root and shoot dry weights; and, for corn plants, ear length and diameter. Changes in physiological properties can be identified by evaluating responses to stress conditions, for example assays using imposed stress conditions such as water deficit, nitrogen deficiency, cold growing conditions, pathogen or insect attack or light deficiency, or increased plant density. Changes in morphology can be measured by visual observation of tendency of a transformed plant with an enhanced agronomic trait to also appear to be a normal plant as compared to changes toward bushy, taller, thicker, narrower leaves, striped leaves, knotted trait, chlorosis, albino, anthocyanin production, or altered tassels, ears or roots. Other selection properties include days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy, green snap, and pest resistance. In addition, phenotypic characteristics of harvested grain may be evaluated, including number of kernels per row on the ear, number of rows of kernels on the ear, kernel abortion, kernel weight, kernel size, kernel density and physical grain quality.

Assays for screening for a desired trait are readily designed by those practicing in the art. The following illustrates useful screening assays for corn traits using hybrid corn plants. The assays can be readily adapted for screening other plants such as canola, cotton and soybean either as hybrids or inbreds.

Transgenic corn plants having nitrogen use efficiency are identified by screening in fields with three levels of nitrogen (N) fertilizer being applied, e.g. low level (0 N), medium level (80 lb/ac) and high level (180 lb/ac). Plants with enhanced nitrogen use efficiency provide higher yield as compared to control plants.

Transgenic corn plants having enhanced yield are identified by screening using progeny of the transgenic plants over multiple locations with plants grown under optimal production management practices and maximum weed and pest control. A useful target for improved yield is a 5% to 10% increase in yield as compared to yield produced by plants grown from seed for a control plant. Selection methods may be applied in multiple and diverse geographic locations, for example up to 16 or more locations, over one or more planting seasons, for example at least two planting seasons, to statistically distinguish yield improvement from natural environmental effects.

Transgenic corn plants having enhanced water use efficiency are identified by screening plants in an assay where water is withheld for a period to induce stress followed by watering to revive the plants. For example, a useful selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment.

Transgenic corn plants having enhanced cold tolerance are identified by screening plants in a cold germination assay and/or a cold tolerance field trial. In a cold germination assay trays of transgenic and control seeds are placed in a growth chamber at 9.7° C. for 24 days (no light). Seeds having higher germination rates as compared to the control are identified as having enhanced cold tolerance. In a cold tolerance field trial plants with enhanced cold tolerance are identified from field planting at an earlier date than conventional Spring planting for the field location. For example, seeds are planted into the ground around two weeks before local farmers begin to plant corn so that a significant cold stress is exerted onto the crop, named as cold treatment. Seeds also are planted under local optimal planting conditions such that the crop has little or no exposure to cold condition, named as normal treatment. At each location, seeds are planted under both cold and normal conditions preferably with multiple repetitions per treatment.

Transgenic corn plants having seeds with increased protein and/or oil levels are identified by analyzing progeny seed for protein and/or oil. Near-infrared transmittance spectrometry is a non-destructive, high-throughput method that is useful to determine the composition of a bulk seed sample for properties listed in table 2.

TABLE 2

| Typical sample(s): | Whole grain corn and soybean seeds |
|---|---|
| Typical analytical range: | Corn-moisture 5-15%, oil 5-20%, protein 5-30%, starch 50-75%, and density 1.0-1.3%. Soybean-moisture 5-15%, oil 15-25%, and protein 35-50%. |

Although the plant cells and methods of this invention can be applied to any plant cell, plant, seed or pollen, e.g. any fruit, vegetable, grass, tree or ornamental plant, the various aspects of the invention are preferably applied to corn, soybean, cotton, canola, alfalfa, wheat, rice, sugarcane, and sugar beet plants. In many cases the invention is applied to corn plants that are inherently resistant to disease from the Mal de Rio Cuarto virus or the *Puccina sorghi* fungus or both.

The following examples are included to demonstrate aspects of the invention, those of skill in the art should, in light of the present disclosure, appreciate that many changes can be made in the specific aspects which are disclosed and still obtain a like or similar results without departing from the spirit and scope of the invention.

EXAMPLE 1

Plant Expression Constructs

This example illustrates the construction of plasmids for transferring recombinant DNA into a plant cell nucleus that can be regenerated into transgenic plants.

A. Plant Expression Constructs for Corn Transformation

A base corn transformation vector pMON93039, as set forth in SEQ ID NO:1352, illustrated in Table 3 and FIG. 1, is fabricated for use in preparing recombinant DNA for *Agrobacterium*-mediated transformation into corn tissue.

TABLE 3

| Function | Name | Annotation | Coordinates of SEQ ID NO: 1352 |
|---|---|---|---|
| *Agrobacterium* T-DNA transfer | B-AGRtu.right border | Agro right border sequence, essential for transfer of T-DNA. | 11364-11720 |
| Gene of interest expression cassette | E-Os.Act1 | Upstream promoter region of the rice actin 1 gene | 19-775 |
| | E-CaMV.35S.2xA1-B3 | Duplicated35S A1-B3 domain without TATA box | 788-1120 |
| | P-Os.Act1 | Promoter region of the rice actin 1 gene | 1125-1204 |
| | L-Ta.Lhcb1 | 5' untranslated leader of wheat major chlorophyll a/b binding protein | 1210-1270 |
| | I-Os.Act1 | First intron and flanking UTR exon sequences from the rice actin 1 gene | 1287-1766 |
| | T-St.Pis4 | 3' non-translated region of the potato proteinase inhibitor II gene which functions to direct polyadenylation of the mRNA | 1838-2780 |
| Plant selectable marker expression cassette | P-Os.Act1 | Promoter from the rice actin 1 gene | 2830-3670 |
| | L-Os.Act1 | First exon of the rice actin 1 gene | 3671-3750 |
| | I-Os.Act1 | First intron and flanking UTR exon sequences from the rice actin 1 gene | 3751-4228 |
| | TS-At.ShkG-CTP2 | Transit peptide region of *Arabidopsis* EPSPS | 4238-4465 |
| | CR-AGRtu.aroA-CP4.nat | Coding region for bacterial strain CP4 native aroA gene. | 4466-5833 |
| | T-AGRtu.nos | A 3' non-translated region of the nopaline synthase gene of *Agrobacterium tumefaciens* Ti plasmid which functions to direct polyadenylation of the mRNA. | 5849-6101 |
| *Agrobacterium* T-DNA transfer | B-AGRtu.left border | Agro left border sequence, essential for transfer of T-DNA. | 6168-6609 |
| Maintenance in *E. coli* | OR-Ec.oriV-RK2 | The vegetative origin of replication from plasmid RK2. | 6696-7092 |
| | CR-Ec.rop | Coding region for repressor of primer from the ColE1 plasmid. Expression of this gene product interferes with primer binding at the origin of replication, keeping plasmid copy number low. | 8601-8792 |
| | OR-Ec.ori-ColE1 | The minimal origin of replication from the *E. coli* plasmid ColE1. | 9220-9808 |
| | P-Ec.aadA-SPC/STR | Promoter for Tn7 adenylyltransferase (AAD(3")) | 10339-10380 |
| | CR-Ec.aadA-SPC/STR | Coding region for Tn7 adenylyltransferase (AAD(3")) conferring spectinomycin and streptomycin resistance. | 10381-11169 |
| | T-Ec.aadA-SPC/STR | 3' UTR from the Tn7 adenylyltransferase (AAD(3")) gene of *E. coli*. | 11170-11227 |

To construct transformation vectors for expressing a protein identified in Table 1, primers for PCR amplification of the protein coding nucleotides are designed at or near the start and stop codons of the coding sequence, in order to eliminate most of the 5' and 3' untranslated regions. The protein coding nucleotides are inserted into the base vector in the gene of interest expression cassette at an insertion site, i.e. between the intron element (coordinates 1287-1766) and the polyadenylation element (coordinates 1838-2780).

To construct transformation vectors for suppressing a protein identified in Table 1, the amplified protein coding nucleotides are assembled in a sense and antisense arrangement and inserted into the base vector at the insertion site in the gene of interest expression cassette to provide transcribed RNA that will form a double-stranded RNA for RNA interference suppression of the protein. In the embodiments of this invention the proteins that are suppressed are ZmLac, ZmGS3, and ZmBB.

B. Plant Expression Constructs for Soy and Canola Transformation

Figure 2:
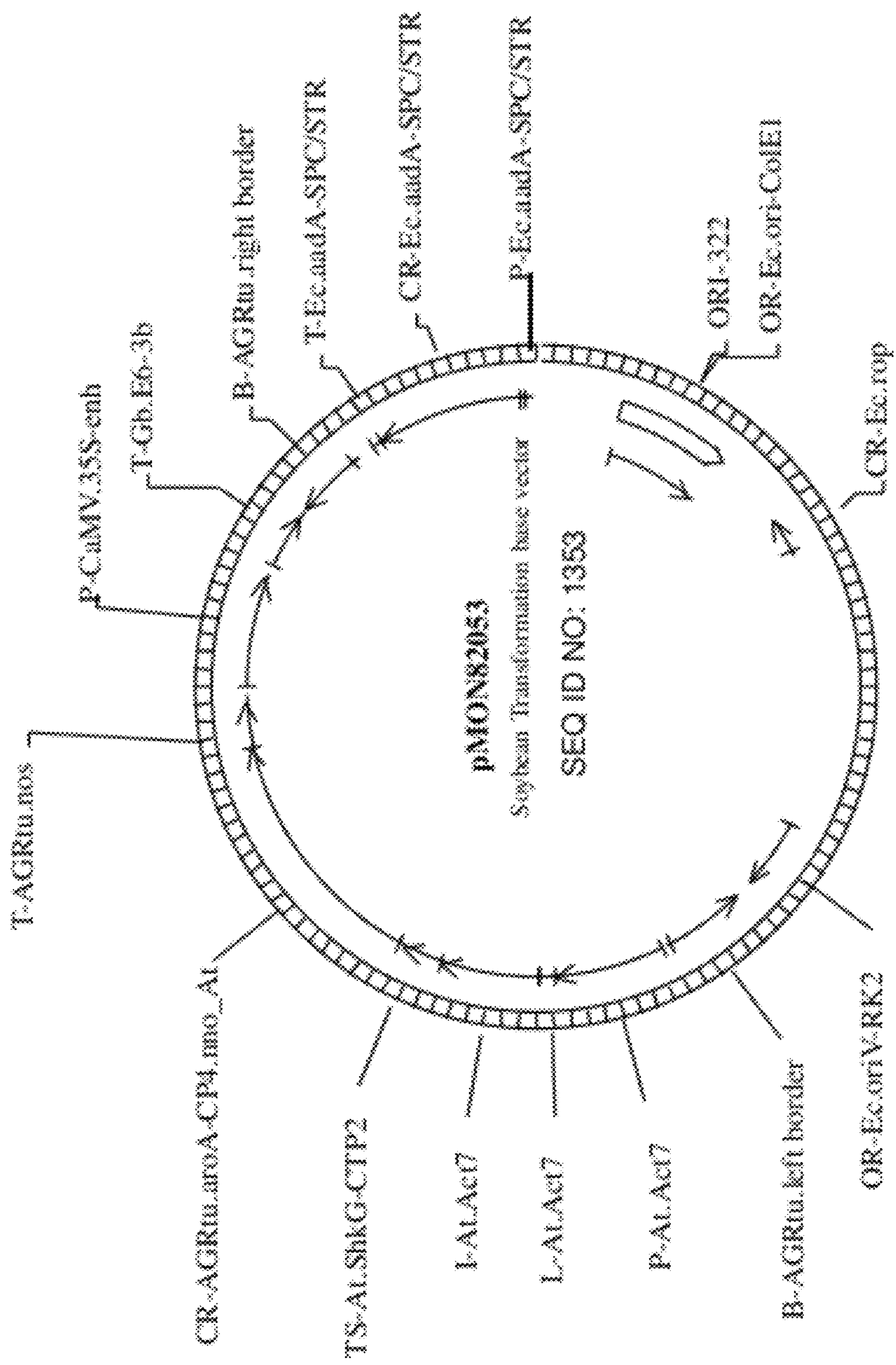

Vectors for use in transformation of soybean and canola tissue are prepared having the elements of expression vector pMON82053 (SEQ ID NO: 1353) as shown in Table 4 below and FIG. 2.

TABLE 4

| Function | Name | Annotation | Coordinates of SEQ ID NO: 1353 |
|---|---|---|---|
| *Agrobacterium* T-DNA transfer | B-AGRtu.left border | Agro left border sequence, essential for transfer of T-DNA. | 6144-6585 |
| Plant selectable marker expression cassette | P-At.Act7 | Promoter from the *Arabidopsis* actin 7 gene | 6624-7861 |
| | L-At.Act7 | 5'UTR of *Arabidopsis* Act7 gene | |
| | I-At.Act7 | Intron from the *Arabidopsis* actin7 gene | |
| | TS-At.ShkG-CTP2 | Transit peptide region of *Arabidopsis* EPSPS | 7864-8091 |
| | CR-AGRtu.aroA-CP4.nno_At | Synthetic CP4 coding region with dicot preferred codon usage. | 8092-9459 |
| | T-AGRtu.nos | A 3' non-translated region of the nopaline synthase gene of *Agrobacterium tumefaciens* Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-613 |
| | T-Gb.E6-3b | 3' untranslated region from the fiber protein E6 gene of sea-island cotton. | 688-1002 |
| *Agrobacterium* T-DNA transfer | B-AGRtu.right border | Agro right border sequence, essential for transfer of T-DNA. | 1033-1389 |
| Maintenance in *E. coli* | OR-Ec.oriV-RK2 | The vegetative origin of replication from plasmid RK2. | 5661-6057 |
| | CR-Ec.rop | Coding region for repressor of primer from the ColE1 plasmid. Expression of this gene product interferes with primer binding at the origin of replication, keeping plasmid copy number low. | 3961-4152 |
| | OR-Ec.ori-ColE1 | The minimal origin of replication from the *E. coli* plasmid ColE1. | 2945-3533 |
| | P-Ec.aadA-SPC/STR | Promoter for Tn7 adenylyltransferase (AAD(3")) | 2373-2414 |
| | CR-Ec.aadA-SPC/STR | Coding region for Tn7 adenylyltransferase (AAD(3")) conferring spectinomycin and streptomycin resistance. | 1584-2372 |
| | T-Ec.aadA-SPC/STR | 3' UTR from the Tn7 adenylyltransferase (AAD(3")) gene of *E. coli*. | 1526-1583 |

To construct transformation vectors for expressing a protein identified in Table 1, primers for PCR amplification of the protein coding nucleotides are designed at or near the start and stop codons of the coding sequence, in order to eliminate most of the 5' and 3' untranslated regions. The protein coding nucleotides are inserted into the base vector in the gene of interest expression cassette at an insertion site, i.e. between the promoter element (coordinates 1-613) and the polyadenylation element (coordinates 688-1002).

To construct transformation vectors for suppressing a protein identified in Table 1, the amplified protein coding nucleotides are assembled in a sense and antisense arrangement and inserted into the base vector at the insertion site in the gene of interest expression cassette to provide transcribed RNA that will form a double-stranded RNA for RNA interference suppression of the protein. In the embodiments of this invention the proteins that are suppressed are ZmLac, ZmGS3, and ZmBB.

C. Cotton Transformation Vector

Figure 3:
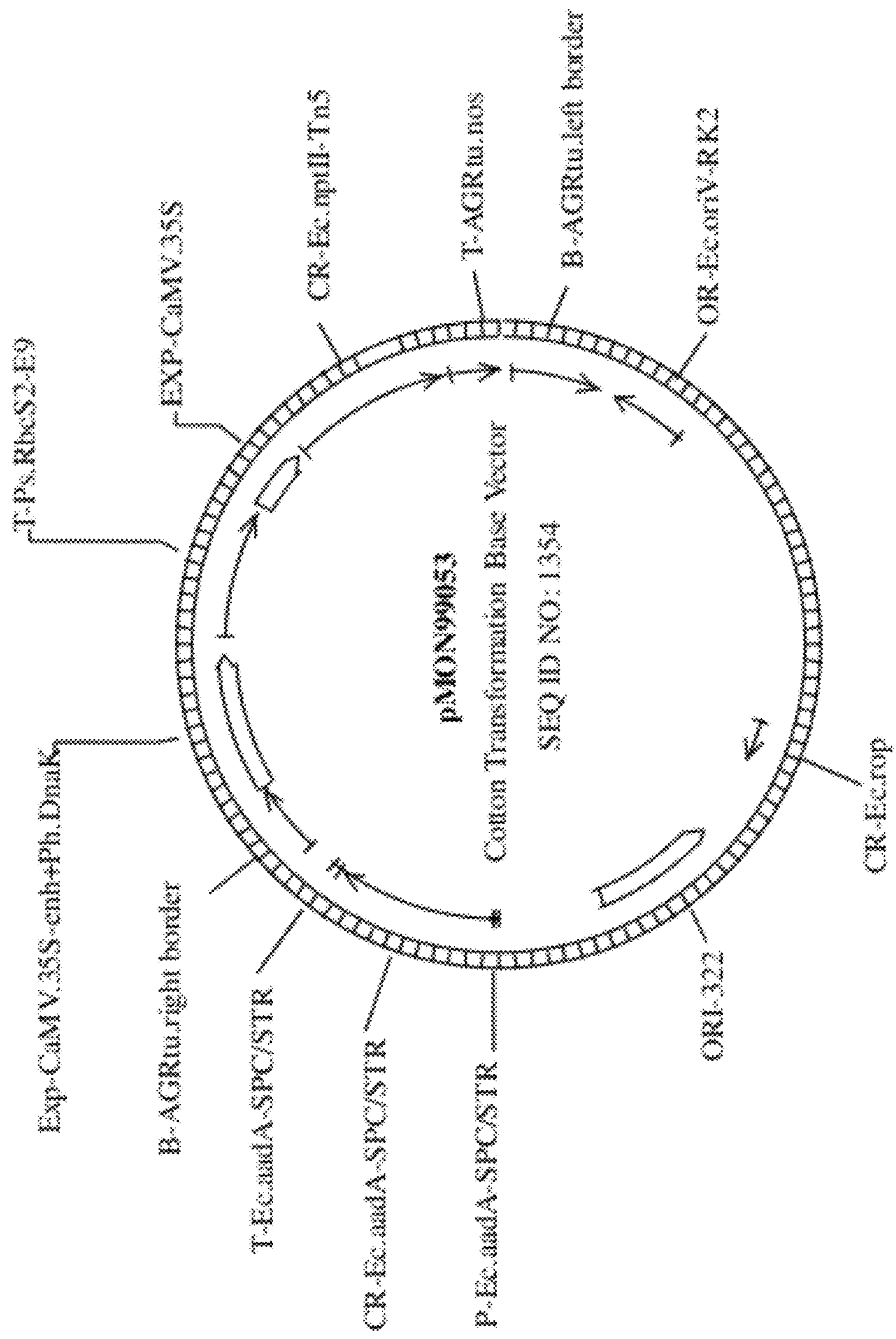

Plasmids for use in transformation of cotton tissue are prepared with elements of expression vector pMON99053 (SEQ ID NO: 1354) as shown in Table 5 below and FIG. 3.

TABLE 5

| Function | Name | Annotation | Coordinates of SEQ ID NO: 1354 |
|---|---|---|---|
| Agrobacterium T-DNA transfer | B-AGRtu.right border | Agro right border sequence, essential for transfer of T-DNA. | 1-357 |
| Gene of interest expression cassette | Exp-CaMV.35S-enh + Ph.DnaK | Enhanced version of the 35S RNA promoter from CaMV plus the petunia hsp70 5' untranslated region | 388-1091 |
| | T-Ps.RbcS2-E9 | The 3' non-translated region of the pea RbcS2 gene which functions to direct polyadenylation of the mRNA. | 1165-1797 |
| Plant selectable marker expression cassette | Exp-CaMV.35S | Promoter and 5' untranslated region from the 35S RNA of CaMV | 1828-2151 |
| | CR-Ec.nptII-Tn5 | Coding region for neomycin phosphotransferase gene from transposon Tn5 which confers resistance to neomycin and kanamycin. | 2185-2979 |
| | T-AGRtu.nos | A 3' non-translated region of the nopaline synthase gene of *Agrobacterium tumefaciens* Ti plasmid which functions to direct polyadenylation of the mRNA. | 3011-3263 |
| Agrobacterium T-DNA transfer | B-AGRtu.left border | Agro left border sequence, essential for transfer of T-DNA. | 3309-3750 |
| Maintenance in *E. coli* | OR-Ec.oriV-RK2 | The vegetative origin of replication from plasmid RK2. | 3837-4233 |
| | CR-Ec.rop | Coding region for repressor of primer from the ColE1 plasmid. Expression of this gene product interferes with primer binding at the origin of replication, keeping plasmid copy number low. | 5742-5933 |
| | OR-Ec.ori-ColE1 | The minimal origin of replication from the *E. coli* plasmid ColE1. | 6361-6949 |
| | P-Ec.aadA-SPC/STR | Promoter for Tn7 adenylyltransferase (AAD(3")) | 7480-7521 |
| | CR-Ec.aadA-SPC/STR | Coding region for Tn7 adenylyltransferase (AAD(3")) conferring spectinomycin and streptomycin resistance. | 7522-8310 |
| | T-Ec.aadA-SPC/STR | 3' UTR from the Tn7 adenylyltransferase (AAD(3")) gene of *E. coli*. | 8311-8368 |

To construct transformation vectors for expressing a protein identified in Table 1, primers for PCR amplification of the protein coding nucleotides are designed at or near the start and stop codons of the coding sequence, in order to eliminate most of the 5' and 3' untranslated regions. The protein coding nucleotides are inserted into the base vector in the gene of interest expression cassette at an insertion site, i.e. between the promoter element (coordinates 388-1091) and the polyadenylation element (coordinates 1165-1797).

To construct transformation vectors for suppressing a protein identified in Table 1, the amplified protein coding nucleotides are assembled in a sense and antisense arrangement and inserted into the base vector at the insertion site in the gene of interest expression cassette to provide transcribed RNA that will form a double-stranded RNA for RNA interference suppression of the protein. In the embodiments of this invention the proteins that are suppressed are ZmLac, ZmGS3, and ZmBB.

D. Plant Expression Constructs for Gene Stacking in Corn.

Figure 4:
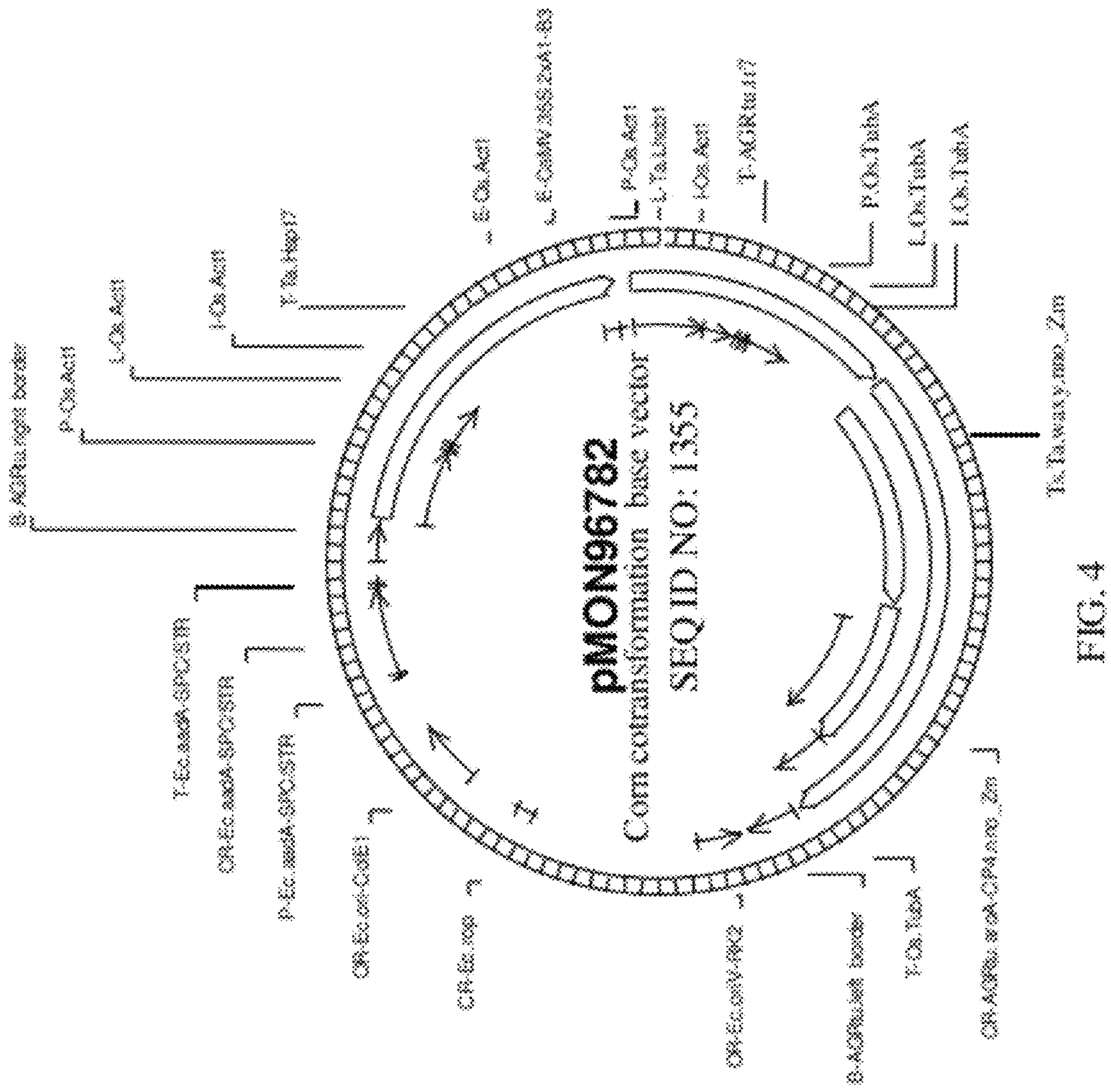

A base corn transformation vector pMON96782, as set forth in SEQ ID NO: 1355, illustrated in Table 6 and FIG. 4, is fabricated for use in preparing recombinant DNA for *Agrobacterium*-mediated transformation into corn tissue.

TABLE 6

| Function | Name | Annotation | Coordinates of SEQ ID NO: 1355 |
|---|---|---|---|
| Agrobacterium T-DNA transfer | B-AGRtu.right border | Agro right border sequence, essential for transfer of T-DNA. | 1-357 |
| Gene of interest expression cassette 1 | P-Os.Act1 | Promoter region of the rice actin 1 gene | 403-1243 |
| | L-Os.Act1 | 5' untranslated leader of rice actin 1 gene | 1244-1323 |
| | I-Os.Act1 | First intron and flanking UTR exon sequences from the rice actin 1 gene | 1324-1801 |
| | T-Ta.Hsp17 | 3' un-translated region of wheat low molecular weight heat shock protein gene | 1834-2043 |

TABLE 6-continued

| Function | Name | Annotation | Coordinates of SEQ ID NO: 1355 |
|---|---|---|---|
| Gene of interest expression cassette 2 | E-Os.Act1 | Upstream Promoter region of rice actin 1 | 2136-2892 |
| | E-CaMV.35S.2xA1-B3 | 35S A1-B3 Domain | 2905-2937 |
| | P-Os.Act1 | Promoter from rice actin gene | 3242-3321 |
| | L-Ta.Lhcb1 | 5' untranslated leader from wheat chlorophyll protein | 3327-3387 |
| | I-Os.Act1 | Intron and 5' untranslated region from rice actin 1 gene | 3404-3883 |
| | T-AGRtu.tr7 | 3' untranslated region from "transcript 7" of Agrobacterium | 3918-4425 |
| Plant selectable marker expression cassette | P.Os.TubA | Promoter of alpha-tubulin gene of rice | 4452-5650 |
| | L.Os.TubA | 5' untranslated region of an alpha tubulin from rice | 5651-5736 |
| | I.Os.TubA | Intron 1 of an alpha tubulin from rice. | 5737-6632 |
| | Ts.Ta.waxy.nno_Zm | Chloroplast transit peptide from wheat starch synthase | 6637-6846 |
| | Cr.AGRtu.aroA-CP4.nno_Zm | CP4 EPSPS gene | 6847-8214 |
| | T.Os.TubA | 3' untranslated region of alpha tubulin from rice | 8219-8800 |
| Agrobacterium T-DNA transfer | B-AGRtu.left border | Left border sequence for T-DNA transfer | 8828-9269 |
| Maintenance in *E. coli* | OR-Ec.oriV-RK2 | Origin of replication from the *E. coli* plasmid RK2. | 9356-9752 |
| | Cr-Ec.rop | Coding region for repressor of primer from ColE1 plasmid | 11261-11452 |
| | OR-Ec.ori-ColE1 | Minimum origin of replication from *E. coli* colE1 plasmid. | 11880-12468 |
| | P-Ec.aadA-SPC/STR | Promoter for Tn7 adenylyltransferase gene | 12999-13040 |
| | CR-Ec.aadA-SPC/STR | Coding region for Tn7 adenylyltransferase gene | 13041-13829 |
| | T-Ec.aadA-SPC/STR | 3' untranslated region from Tn7 adenylyltransferase gene | 13830-13887 |

Primers for PCR amplification of protein coding nucleotides of the genes of interest are designed at or near the start and stop codons of the coding sequence, in order to eliminate most of the 5' and 3' untranslated regions. Protein coding regions of genes encoding a first and second protein of interest are amplified. The amplified region from the first gene of interest is cloned between nucleotides 1801 and 1834 of the base vector and the amplified region from the second gene of interest is cloned between nucleotides 3883 and 3918 of the base vector.

EXAMPLE 2

Corn Transformation

This example illustrates transformation methods useful in producing a transgenic nucleus in a corn plant cell, and the plants, seeds and pollen produced from a transgenic cell with such a nucleus having an enhanced trait, i.e. enhanced water use efficiency, enhanced cold tolerance, increased yield, enhanced nitrogen use efficiency, enhanced seed protein and enhanced seed oil. A plasmid vector is prepared by cloning the DNA of SEQ ID NO:1 into the gene of interest expression cassette in the base vector for use in corn transformation of corn tissue provided in Example 1, Table 3.

For *Agrobacterium*-mediated transformation of corn embryo cells corn plants of a readily transformable line are grown in the greenhouse and ears are harvested when the embryos are 1.5 to 2.0 mm in length. Ears are surface sterilized by spraying or soaking the ears in 80% ethanol, followed by air drying. Immature embryos are isolated from individual kernels on surface sterilized ears. Prior to inoculation of maize cells, *Agrobacterium* cells are grown overnight at room temperature. Immature maize embryo cells are inoculated with *Agrobacterium* shortly after excision, and incubated at room temperature with *Agrobacterium* for 5-20 minutes. Immature embryo plant cells are then co-cultured with *Agrobacterium* for 1 to 3 days at 23° C. in the dark. Co-cultured embryos are transferred to selection media and cultured for approximately two weeks to allow embryogenic callus to develop. Embryogenic callus is transferred to culture medium containing 100 mg/L paromomycin and subcultured at about two week intervals. Transformed plant cells are recovered 6 to 8 weeks after initiation of selection.

For *Agrobacterium*-mediated transformation of maize callus immature embryos are cultured for approximately 8-21 days after excision to allow callus to develop. Callus is then incubated for about 30 minutes at room temperature with the *Agrobacterium* suspension, followed by removal of the liquid by aspiration. The callus and *Agrobacterium* are co-cultured without selection for 3-6 days followed by selection on paromomycin for approximately 6 weeks, with biweekly transfers to fresh media. Paromomycin resistant calli are identified about 6-8 weeks after initiation of selection.

To regenerate transgenic corn plants a callus of transgenic plant cells resulting from transformation and selection is placed on media to initiate shoot development into plantlets which are transferred to potting soil for initial growth in a growth chamber at 26° C. followed by a mist bench before transplanting to 5 inch pots where plants are grown to maturity. The regenerated plants are self-fertilized and seed is harvested for use in one or more methods to select seeds, seedlings or progeny second generation transgenic plants (R2 plants) or hybrids, e.g. by selecting transgenic plants exhibiting an enhanced trait as compared to a control plant.

The above process is repeated to produce multiple events of transgenic corn plant cells that are transformed with recombinant DNA from each of the genes identified in Table 1. Events are designed to produce in the transgenic cells one of the proteins identified in Table 1, except the proteins of SEQ ID NOs: 11 and 17-19 which are suppressed. Progeny transgenic plants and seed of the transformed plant cells are screened for enhanced water use efficiency, enhanced cold tolerance, increased yield, enhanced nitrogen use efficiency, enhanced seed protein and enhanced seed oil. From each group of multiple events of transgenic plants with a specific recombinant DNA from Table 1 the event that produces the greatest enhancement in yield, water use efficiency, nitrogen use efficiency, enhanced cold tolerance, enhanced seed protein and enhanced seed oil is identified and progeny seed is selected for commercial development.

EXAMPLE 3

Soybean Transformation

This example illustrates plant transformation useful in producing a transgenic nucleus in a soybean plant cell, and the plants, seeds and pollen produced from a transgenic cell with such a nucleus having an enhanced trait, i.e. enhanced water use efficiency, enhanced cold tolerance, increased yield, enhanced nitrogen use efficiency, enhanced seed protein and enhanced seed oil.

For *Agrobacterium* mediated transformation, soybean seeds are imbided overnight and the meristem explants excised. The explants are placed in a wounding vessel. Soybean explants and induced *Agrobacterium* cells from a strain containing plasmid DNA with the gene of interest cassette and a plant selectable marker cassette are mixed no later than 14 hours from the time of initiation of seed imbibition, and wounded using sonication. Following wounding, explants are placed in co-culture for 2-5 days at which point they are transferred to selection media for 6-8 weeks to allow selection and growth of transgenic shoots. Resistant shoots are harvested approximately 6-8 weeks and placed into selective rooting media for 2-3 weeks. Shoots producing roots are transferred to the greenhouse and potted in soil. Shoots that remain healthy on selection, but do not produce roots are transferred to non-selective rooting media for an additional two weeks. Roots from any shoots that produce roots off selection are tested for expression of the plant selectable marker before they are transferred to the greenhouse and potted in soil.

The above process is repeated to produce multiple events of transgenic soybean plant cells that are transformed with recombinant DNA from each of the genes identified in Table 1. Events are designed to produce in the transgenic cells one of the proteins identified in Table 1, except the proteins of SEQ ID NOs: 11, and 17-19 which are suppressed. Progeny transgenic plants and seed of the transformed plant cells are screened for enhanced water use efficiency, enhanced cold tolerance, increased yield, enhanced seed protein and enhanced seed oil. From each group of multiple events of transgenic plants with a specific recombinant DNA from Table 1 the event that produces the greatest enhancement in yield, water use efficiency, nitrogen use efficiency, enhanced cold tolerance, enhanced seed protein and enhanced seed oil is identified and progeny seed is selected for commercial development.

EXAMPLE 4

Cotton Transgenic Plants with Enhanced Agronomic Traits

This example illustrates plant transformation useful in producing a transgenic nucleus in a cotton plant cell, and the plants, seeds and pollen produced from a transgenic cell with such a nucleus having an enhanced trait, i.e. enhanced water use efficiency, increased yield, enhanced nitrogen use efficiency and enhanced seed oil.

Transgenic cotton plants containing each recombinant DNA having a sequence of SEQ ID NO: 1 through SEQ ID NO: 10 are obtained by transforming with recombinant DNA from each of the genes identified in Table 1 using *Agrobacterium*-mediated transformation. The above process is repeated to produce multiple events of transgenic cotton plant cells that are transformed with recombinant DNA from each of the genes identified in Table 1. Events are designed to produce in the transgenic cells one of the proteins identified in Table 1, except the proteins of SEQ ID NOs: 11, and 17-19 which are suppressed.

From each group of multiple events of transgenic plants with a specific recombinant DNA from Table 1 the event that produces the greatest enhancement in yield, water use efficiency, nitrogen use efficiency, enhanced cold tolerance, enhanced seed protein and enhanced seed oil is identified and progeny seed is selected for commercial development.

Progeny transgenic plants are selected from a population of transgenic cotton events under specified growing conditions and are compared with control cotton plants. Control cotton plants are substantially the same cotton genotype but without the recombinant DNA, for example, either a parental cotton plant of the same genotype that was not transformed with the identical recombinant DNA or a negative isoline of the transformed plant. Additionally, a commercial cotton cultivar adapted to the geographical region and cultivation conditions, i.e. cotton variety ST474, cotton variety FM 958, and cotton variety Siokra L-23, are used to compare the relative performance of the transgenic cotton plants containing the recombinant DNA.

Transgenic cotton plants with enhanced yield and water use efficiency are identified by growing under variable water conditions. Specific conditions for cotton include growing a first set of transgenic and control plants under "wet" conditions, i.e. irrigated in the range of 85 to 100 percent of evapotranspiration to provide leaf water potential of −14 to −18 bars, and growing a second set of transgenic and control plants under "dry" conditions, i.e. irrigated in the range of 40 to 60 percent of evapotranspiration to provide a leaf water potential of −21 to −25 bars. Pest control, such as weed and insect control is applied equally to both wet and dry treatments as needed. Data gathered during the trial includes weather records throughout the growing season including detailed records of rainfall; soil characterization information; any herbicide or insecticide applications; any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for the trial area. Enhanced water use efficiency is indicated by increased yield, improved relative water content, enhanced leaf water potential, increased biomass, enhanced leaf extension rates, and improved fiber parameters.

EXAMPLE 5

Canola Transformation

This example illustrates plant transformation useful in producing the transgenic canola plants of this invention and the production and identification of transgenic seed for transgenic canola having enhanced water use efficiency, enhanced cold tolerance, increased yield, enhanced nitrogen use efficiency, enhanced seed protein and enhanced seed oil.

Tissues from in vitro grown canola seedlings are prepared and inoculated with overnight-grown *Agrobacterium* cells containing plasmid DNA with the gene of interest cassette and a plant selectable marker cassette. Following co-cultivation with *Agrobacterium*, the infected tissues are allowed to grow on selection to promote growth of transgenic shoots, followed by growth of roots from the transgenic shoots. The selected plantlets are then transferred to the greenhouse and potted in soil. Molecular characterizations are performed to confirm the presence of the gene of interest, and its expression in transgenic plants and progenies. Progeny transgenic plants are selected from a population of transgenic canola events under specified growing conditions and are compared with control canola plants. Control canola plants are substantially the same canola genotype but without the recombinant DNA, for example, either a parental canola plant of the same genotype that is not transformed with the identical recombinant DNA or a negative isoline of the transformed plant.

Transgenic canola plant cells are transformed with each of the recombinant DNA identified in Table 1. The above process is repeated to produce multiple events of transgenic canola plant cells that are transformed with recombinant DNA from each of the genes identified in Table 1. Events are designed to produce in the transgenic cells one of the proteins identified in Table 1, except the proteins of SEQ ID NOs: 11, and 17-19 which are suppressed. Progeny transgenic plants and seed of the transformed plant cells are screened for enhanced water use efficiency, enhanced cold tolerance, increased yield, enhanced seed protein and enhanced seed oil. From each group of multiple events of transgenic plants with a specific recombinant DNA from Table 1 the event that produces the greatest enhancement in yield, water use efficiency, nitrogen use efficiency, enhanced cold tolerance, enhanced seed protein and enhanced seed oil is identified and progeny seed is selected for commercial development.

EXAMPLE 6

Homolog Identification

This example illustrates the identification of homologs of proteins encoded by the DNA identified in Table 1 which is used to provide transgenic seed and plants having enhanced agronomic traits. From the sequence of the homologs, homologous DNA sequence can be identified for preparing additional transgenic seeds and plants of this invention with enhanced agronomic traits.

An "All Protein Database" was constructed of known protein sequences using a proprietary sequence database and the National Center for Biotechnology Information (NCBI) non-redundant amino acid database (nr.aa). For each organism from which a polynucleotide sequence provided herein was obtained, an "Organism Protein Database" was constructed of known protein sequences of the organism; it is a subset of the All Protein Database based on the NCBI taxonomy ID for the organism.

The All Protein Database was queried using amino acid sequences provided herein as SEQ ID NO: 11 through SEQ ID NO: 20 using NCBI "blastp" program with E-value cutoff of 1e-8. Up to 1000 top hits were kept, and separated by organism names. For each organism other than that of the query sequence, a list was kept for hits from the query organism itself with a more significant E-value than the best hit of the organism. The list contains likely duplicated genes of the polynucleotides provided herein, and is referred to as the Core List. Another list was kept for all the hits from each organism, sorted by E-value, and referred to as the Hit List.

The Organism Protein Database was queried using polypeptide sequences provided herein as SEQ ID NO: 11 through SEQ ID NO: 20 using NCBI "blastp" program with E-value cutoff of 1e-4. Up to 1000 top hits were kept. A BLAST searchable database was constructed based on these hits, and is referred to as "SubDB". SubDB is queried with each sequence in the Hit List using NCBI "blastp" program with E-value cutoff of 1e-8. The hit with the best E-value was compared with the Core List from the corresponding organism. The hit is deemed a likely ortholog if it belongs to the Core List, otherwise it is deemed not a likely ortholog and there is no further search of sequences in the Hit List for the same organism. Homologs from a large number of distinct organisms were identified and are reported below in table 7 with the SEQ ID NO of the original query sequence and the identified homologs as [SEQ ID NO]: [Homolog SEQ ID NOs].

TABLE 7

| Protein Sequences and their Homologs |
|---|
| 11: 24 28 32 34 40 44 46 47 49 50 51 52 53 60 68 71 72 74 75 80 81 85 87 90 118 120 121 129 135 143 153 154 157 159 164 168 173 176 182 184 194 197 200 202 203 213 214 228 237 246 248 249 251 253 255 258 261 268 274 277 292 294 299 303 306 313 314 320 325 326 328 333 347 348 349 354 355 357 360 361 362 363 364 365 366 370 374 383 389 390 391 395 397 425 426 431 434 436 456 457 459 463 467 469 470 471 472 473 474 477 480 488 490 492 499 508 515 522 529 530 532 540 541 555 568 574 577 578 579 581 585 587 588 589 595 596 598 600 610 616 618 621 623 626 633 638 639 640 643 644 645 651 652 658 661 662 663 666 674 677 691 692 693 694 695 709 717 718 720 728 729 745 746 753 756 757 774 775 784 787 791 793 799 801 810 825 831 837 850 851 856 857 865 866 868 871 873 875 876 879 881 886 888 891 892 896 899 904 905 906 908 916 917 919 929 935 940 943 946 948 950 962 963 964 969 974 |

TABLE 7-continued

| Protein Sequences and their Homologs |
|---|
| 982 993 997 1005 1009 1011 1013 1015 1027 1028 1031 1032 1035 1049 1050 1059 1066 1068 1069 1076 1083 1085 1088 1090 1093 1095 1097 1098 1100 1107 1108 1110 1111 1117 1118 1120 1131 1134 1136 1137 1145 1146 1147 1149 1150 1153 1155 1156 1158 1168 1169 1170 1176 1184 1188 1193 1196 1205 1207 1212 1216 1226 1229 1230 1232 1233 1236 1241 1242 1243 1244 1248 1249 1252 1254 1256 1257 1260 1262 1265 1267 1269 1280 1283 1287 1292 1306 1307 1334 1335 1345 1350 |
| 12: 36 38 43 45 48 56 61 62 65 73 78 79 82 83 84 89 100 107 109 124 126 131 132 142 144 146 148 152 167 171 196 204 206 212 215 218 219 224 233 235 242 243 254 260 264 265 267 279 290 291 295 297 305 311 316 321 322 324 331 332 340 342 358 369 375 398 410 413 414 417 435 437 438 441 462 468 475 485 493 496 498 500 502 504 509 511 516 518 521 525 531 534 538 539 542 546 556 563 580 606 607 611 620 629 632 636 656 664 665 678 683 705 706 710 711 725 738 742 743 762 788 795 798 802 803 812 822 835 838 839 845 846 852 860 863 869 872 877 883 887 894 930 931 936 939 942 944 971 977 979 983 992 999 1007 1010 1030 1046 1048 1065 1075 1087 1091 1112 1113 1119 1124 1133 1135 1181 1182 1192 1195 1197 1206 1211 1213 1217 1219 1220 1223 1234 1235 1237 1239 1246 1247 1251 1258 1259 1261 1266 1300 1310 1317 1321 1328 1331 |
| 13: 23 30 33 42 54 55 63 64 66 88 92 93 94 95 96 97 99 103 104 106 114 115 117 119 127 128 130 138 147 150 151 155 158 160 165 166 175 178 190 191 195 198 208 210 211 221 229 230 238 247 252 256 257 259 262 263 266 272 283 287 317 327 329 330 353 356 368 378 379 385 387 394 399 404 409 411 419 427 428 433 439 440 444 446 449 458 460 461 481 487 503 505 507 510 513 527 537 545 548 550 552 553 557 558 559 564 565 569 572 584 593 602 605 608 609 612 617 619 625 637 647 650 660 672 690 696 703 716 722 726 730 731 735 747 749 750 755 761 766 771 776 779 786 790 794 804 806 811 817 821 824 826 827 828 829 836 841 847 848 854 867 870 878 884 893 895 897 907 909 910 914 918 923 925 928 933 934 951 952 954 955 957 958 959 965 975 985 987 988 991 1012 1019 1020 1022 1029 1033 1034 1036 1039 1041 1043 1044 1052 1056 1057 1060 1061 1063 1071 1072 1073 1084 1086 1094 1102 1115 1122 1126 1128 1144 1148 1151 1159 1161 1162 1173 1174 1177 1179 1189 1190 1201 1202 1203 1208 1221 1225 1227 1228 1231 1255 1270 1273 1278 1279 1291 1296 1301 1302 1318 1322 1324 1330 1338 1346 1348 |
| 14: 23 30 33 54 55 63 64 66 88 91 92 93 94 95 96 97 99 103 104 106 112 115 117 119 127 128 130 137 138 147 150 151 158 160 162 165 174 175 178 181 186 189 190 191 198 201 217 221 229 230 238 244 247 252 256 257 259 262 263 266 269 272 276 283 286 317 318 319 327 329 330 344 353 356 368 379 385 387 393 394 399 404 408 409 411 419 423 427 440 445 446 449 450 458 460 461 482 487 489 503 505 507 510 513 526 527 535 537 545 548 550 551 552 553 557 558 559 569 572 575 584 590 593 603 605 608 609 612 619 625 628 631 637 642 647 650 653 660 668 672 675 688 690 696 700 703 707 716 722 726 730 731 732 735 747 749 750 754 755 761 766 771 776 778 779 780 781 782 786 790 794 804 806 811 817 820 821 824 826 828 836 841 847 848 854 867 870 878 882 884 893 895 897 907 909 910 913 914 918 920 921 923 924 932 933 934 949 951 952 954 955 957 959 960 965 975 985 987 988 991 1012 1019 1020 1022 1026 1029 1033 1034 1036 1039 1041 1043 1044 1052 1057 1060 1061 1063 1071 1072 1073 1077 1084 1086 1094 1102 1109 1126 1128 1132 1138 1144 1148 1157 1159 1161 1162 1173 1174 1177 1179 1189 1190 1202 1203 1208 1221 1222 1225 1228 1231 1255 1270 1271 1273 1276 1284 1289 1291 1293 1301 1302 1318 1322 1324 1346 1348 |
| 15: 21 26 27 31 35 37 41 57 58 59 69 70 76 77 86 98 101 102 108 110 111 113 116 122 123 125 133 136 139 140 145 149 156 161 163 169 170 172 177 180 183 185 187 188 192 193 199 209 216 220 222 223 225 226 227 231 232 234 236 239 240 241 245 250 270 271 273 275 278 280 281 282 284 285 288 289 293 296 298 300 301 302 307 308 309 310 312 315 323 335 336 337 338 339 341 343 345 346 351 352 359 367 371 372 373 376 377 380 381 382 384 386 392 396 400 401 402 403 406 407 412 415 416 418 420 421 422 424 429 430 432 442 443 447 448 452 453 455 464 465 466 476 478 479 483 484 486 491 494 495 497 501 506 517 519 520 523 524 528 533 536 543 547 549 554 560 561 562 566 567 570 571 573 576 582 583 594 597 599 601 604 613 614 615 622 624 627 630 634 635 641 646 648 649 654 655 657 659 667 669 670 671 673 679 681 682 684 685 686 687 689 697 698 699 701 702 704 708 712 714 715 719 721 723 724 727 733 734 736 739 741 744 748 751 752 758 759 760 763 764 765 767 768 769 770 772 773 783 785 789 792 796 800 805 807 808 809 813 814 815 816 818 823 830 832 833 834 840 842 843 844 849 853 855 858 859 861 862 864 874 880 889 890 898 900 901 903 911 915 922 926 927 937 945 947 953 956 961 966 967 968 970 972 973 976 980 981 984 986 989 990 994 995 996 998 1000 1001 1002 1003 1004 1006 1008 1014 1016 1017 1018 1021 1023 1024 1025 1037 1040 1042 1045 1047 1051 1053 1054 1055 1058 1067 1070 1074 1078 1079 1080 1081 1082 1092 1096 1099 1101 1103 1104 1105 1106 1114 1116 1123 1125 1127 1129 1130 1139 1141 1143 1152 1154 1160 1163 1164 1165 1166 1167 1171 1172 1175 1178 1180 1183 1185 1186 1187 1194 1198 1199 1204 1209 1210 1214 1215 1218 1224 1238 1240 1245 1250 1253 1263 1264 1268 1272 1274 1275 1277 1281 1282 1285 1288 1294 1295 1297 1298 1299 1303 1304 1305 1308 1309 1311 1312 1313 1314 1315 1316 1319 1320 1323 1325 1326 1327 1329 1332 1333 1336 1337 1339 1340 1341 1342 1343 1347 1349 1351 |
| 16: 21 26 27 31 35 37 41 57 58 59 69 70 76 77 86 98 101 102 108 110 111 113 116 122 123 125 133 136 139 140 145 149 156 161 163 169 170 172 177 180 183 185 187 188 192 193 199 209 216 220 222 223 225 226 227 231 232 234 236 239 240 241 245 250 270 271 273 275 278 280 281 282 284 285 288 289 293 296 298 300 301 302 307 308 309 310 312 315 323 335 336 337 338 339 341 343 345 346 351 352 359 367 371 372 373 376 377 380 381 382 384 386 392 396 400 401 402 403 406 407 412 415 416 418 420 421 422 424 429 430 432 442 443 447 448 452 453 455 464 465 466 476 478 479 483 484 486 491 494 495 497 501 506 517 519 520 523 524 528 533 536 543 547 549 554 560 561 562 566 567 570 571 573 576 582 583 594 597 599 601 604 613 614 615 622 624 627 630 634 635 641 646 648 649 654 655 657 659 667 669 670 671 673 679 681 682 684 685 686 687 689 697 698 699 701 702 704 708 712 714 715 719 721 723 |

TABLE 7-continued

| Protein Sequences and their Homologs |
|---|
| 724 727 733 734 736 739 741 744 748 751 752 758 759 760 763 764 765 767 768 769 770 772 773 783 785 789 792 796 800 805 807 808 809 813 814 815 816 818 823 830 832 833 834 840 842 843 844 849 853 855 858 859 861 862 864 874 880 889 890 898 900 901 903 911 915 922 926 927 937 945 947 953 956 961 966 967 968 970 972 973 976 980 981 984 986 989 990 994 995 996 998 1000 1001 1002 1003 1004 1006 1008 1014 1016 1017 1018 1021 1023 1024 1025 1037 1040 1042 1045 1047 1051 1053 1054 1055 1058 1067 1070 1074 1078 1079 1080 1081 1082 1092 1096 1099 1101 1103 1104 1105 1106 1114 1116 1123 1125 1127 1129 1130 1139 1141 1143 1152 1154 1160 1163 1164 1165 1166 1167 1171 1172 1175 1178 1180 1183 1185 1186 1187 1194 1198 1199 1204 1209 1210 1214 1215 1218 1224 1238 1240 1245 1250 1253 1263 1264 1268 1272 1274 1275 1277 1281 1282 1285 1288 1294 1295 1297 1298 1299 1303 1304 1305 1308 1309 1311 1312 1313 1314 1315 1316 1319 1320 1323 1325 1326 1327 1329 1332 1333 1336 1337 1339 1340 1341 1342 1343 1347 1349 1351 |
| 17: 179 207 514 586 591 902 1200 1286 |
| 18: 179 207 514 586 591 902 1200 1286 |
| 19: 22 29 141 592 |
| 20: 25 39 67 105 134 205 304 334 350 388 405 451 454 512 544 676 680 713 737 740 777 797 819 885 912 938 941 978 1038 1062 1064 1089 1121 1140 1142 1191 1290 1344 |

Recombinant DNA constructs are prepared using the DNA encoding each of the identified homologs and the constructs are used to prepare multiple events of transgenic corn, soybean, canola and cotton plants as illustrated in Examples 2-5. Plants are regenerated from the transformed plant cells and used to produce progeny plants and seed that are screened for enhanced water use efficiency, enhanced cold tolerance, increased yield, enhanced nitrogen use efficiency, enhanced seed protein and enhanced seed oil. From each group of multiple events of transgenic plants with a specific recombinant DNA for a homolog the event that produces the greatest enhancement in yield, water use efficiency, nitrogen use efficiency, enhanced cold tolerance, enhanced seed protein and enhanced seed oil is identified and progeny seed is selected for commercial development.

EXAMPLE 7

Consensus Sequence

This example illustrates the identification of consensus amino acid sequence for the proteins and homologs encoded by DNA that is used to prepare the transgenic seed and plants of this invention having enhanced agronomic traits.

ClustalW program was selected for multiple sequence alignments of the amino acid sequence of SEQ ID NO: 17-19 and their homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of 1 were chosen for multiple sequence alignment.

The consensus amino acid sequence can be used to identify DNA corresponding to the full scope of this invention that is useful in providing transgenic plants, for example corn and soybean plants with enhanced agronomic traits, for example improved nitrogen use efficiency, improved yield, improved water use efficiency and/or improved growth under cold stress, due to the expression in the plants of DNA suppressing a protein with amino acid sequence identical to the consensus amino acid sequence.

The SEQ ID NOs for the identified consensus sequences are reported in table 8 below and the full consensus sequences are provided in the attached sequence listing.

TABLE 8

| Gene ID | PEP SEQ ID NO | Consensus SEQ ID NO |
|---|---|---|
| Mnom000090 | 17 | 1356 |
| Mnom000091 | 18 | 1357 |
| Mnom000092 | 19 | 1358 |

EXAMPLE 9

Identification of Amino Acid Domain by Pfam Analysis

This example illustrates the identification of domain and domain module by Pfam analysis.

The amino acid sequence of the expressed proteins that are shown to be associated with an enhanced trait were analyzed for Pfam protein family against the current Pfam collection of multiple sequence alignments and hidden Markov models using the HMMER software in the appended computer listing. The Pfam protein domains and modules for the proteins of SEQ ID NO: 11 through 16 and 20 are shown in Tables 9, 10 and 11. The Hidden Markov model databases for the identified patent families are also in the appended computer listing allowing identification of other homologous proteins and their cognate encoding DNA to enable the full breadth of the invention for a person of ordinary skill in the art. Certain proteins are identified by a single Pfam domain and others by multiple Pfam domains.

TABLE 9

| Pfam annotation | | | | | | |
|---|---|---|---|---|---|---|
| PEP SEQ ID NO | Gene ID | Pfam domain name | Begin | Stop | Score | E-value |
| 11 | Mnom000034 | Cu-oxidase__3 | 30 | 146 | 237 | 4.10E−68 |
| 11 | Mnom000034 | Cu-oxidase | 156 | 310 | 158.7 | 1.50E−44 |
| 11 | Mnom000034 | Cu-oxidase__2 | 409 | 532 | 169.9 | 6.30E−48 |
| 12 | Mnom000037 | Flavodoxin__1 | 7 | 160 | 197.3 | 3.70E−56 |
| 13 | Mnom000048 | Glyco__transf__20 | 3 | 470 | 933.9 | 6.70E−278 |
| 13 | Mnom000048 | Trehalose__PPase | 504 | 748 | 256.4 | 6.20E−74 |
| 14 | Mnom000049 | Glyco__transf__20 | 76 | 578 | 841.5 | 4.40E−250 |
| 14 | Mnom000049 | Trehalose__PPase | 627 | 862 | 339.1 | 7.70E−99 |
| 15 | Mnom000067 | Aminotran__1__2 | 60 | 441 | 33.4 | 8.00E−09 |
| 16 | Mnom000068 | Aminotran__1__2 | 60 | 441 | 33.4 | 8.00E−09 |
| 20 | Mnom000095 | B3 | 312 | 417 | 118.5 | 2.00E−32 |
| 20 | Mnom000095 | Auxin__resp | 439 | 524 | 160.7 | 3.80E−45 |
| 20 | Mnom000095 | AUX__IAA | 681 | 826 | −74.9 | 0.00043 |

TABLE 10

| Pfam module annotation | | | |
|---|---|---|---|
| PEP SEQ ID NO | Gene ID | Pfam domain module | Position |
| 11 | Mnom000034 | Cu-oxidase_3::Cu-oxidase::Cu-oxidase_2 | 30-146::156-310::409-532 |
| 12 | Mnom000037 | Flavodoxin_1 | 7-160 |
| 13 | Mnom000048 | Glyco_transf_20::Trehalose_PPase | 3-470::504-748 |
| 14 | Mnom000049 | Glyco_transf_20::Trehalose_PPase | 76-578::627-862 |
| 15 | Mnom000067 | Aminotran_1_2 | 60-441 |
| 16 | Mnom000068 | Aminotran_1_2 | 60-441 |
| 20 | Mnom000095 | 83::Auxin_resp::AUX_IAA | 312-417::439-524::681-826 |

TABLE 11

| Description of Pfam domains | | | |
|---|---|---|---|
| Pfam domain name | Accession number | Gathering cutoff | Domain description |
| AUX_IAA | PF02309.8 | −83.0000; | AUX/IAA family |
| Aminotran_1_2 | PF00155.13 | −57.5000; | Aminotransferase class I and II |
| Auxin_resp | PF06507.5 | 25.0000; | Auxin response factor |
| B3 | PF02362.13 | 26.5000; | B3 DNA binding domain |
| Cu-oxidase | PF00394.14 | −18.9000; | Multicopper oxidase |
| Cu-oxidase_2 | PF07731.6 | −5.8000; | Multicopper oxidase |
| Cu-oxidase_3 | PF07732.7 | 10.0000; | Multicopper oxidase |
| Flavodoxin_1 | PF00258.17 | 6.3000; | Flavodoxin |
| Glyco_transf_20 | PF00982.13 | −243.6000; | Glycosyltransferase family 20 |
| Trehalose_PPase | PF02358.8 | −49.4000; | Trehalose-phosphatase |

HMMER2.0 [2.3.2]
NAME Aminotran_1_2
ACC PF00155.13
DESC Aminotransferase class I and II
LENG 413
ALPH Amino
RF no
CS yes
MAP yes
COM hmmbuild-F HMM_ls.ann SEED.ann
COM hmmcalibrate--seed 0 HMM_ls.ann
NSEQ 48
DATE Wed Jun 4 12:41:51 2008
CKSUM 5427
GA −57.5000 −57.5000;
TC −57.5000 −57.5000;
NC −57.6000 −57.6000;
XT −8455 −4 −1000 −1000 −8455 −4 −8455 −4
NULT −4 −8455
NULE 595 −1558 85 338 −294 453 −1158 197 249 902 −1085 −142 −21 −313 45 531 201 384 −1998 −644
EVD −212.832108 0.112804

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | −35 | * | −5392 | | | | | | | | | | | | | | | | | | |
| 1 | 384 | −4120 | 12 | 570 | −4439 | −1698 | −2284 | 498 | 915 | −4135 | −3209 | −554 | 901 | −1824 | 813 | 250 | 917 | 298 | −4304 | −385 | 1 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | −35 | * | | | | | | | | | | | | |
| 2 | −2650 | −4123 | 1971 | 552 | −4444 | −198 | 1098 | 914 | 1158 | −4139 | −382 | 592 | 363 | −328 | −1015 | −1280 | −157 | −734 | −4306 | −3624 | 2 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 3 | −2896 | 567 | −1147 | −1357 | −571 | −676 | −3254 | 799 | 1757 | 207 | 1073 | −3928 | −976 | 1299 | −3869 | −3471 | −2836 | 1527 | 1087 | −313 | 3 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 4 | −3740 | −3485 | −6136 | −1671 | −464 | −5430 | −4361 | 2501 | −5177 | 1229 | 2607 | −5079 | −5398 | −4771 | −4988 | −4546 | 121 | 1441 | −4111 | −3808 | 4 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 5 | −2664 | −4004 | 1304 | −2017 | −4272 | 968 | −2324 | −1512 | 1015 | −186 | −3107 | 2717 | −756 | −1883 | −703 | −1108 | −2603 | −798 | 822 | −3571 | 5 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 6 | −6226 | −5561 | −8547 | −7962 | 1608 | −8401 | −6727 | −3026 | −7769 | 3021 | 248 | −8082 | −7277 | −6383 | −7165 | −7815 | −6037 | −1618 | 2137 | −5272 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 7 | 1299 | 2232 | −264 | −5671 | −6629 | 2106 | −5515 | −6437 | −5715 | −6634 | −5683 | 1058 | −5145 | −5375 | −5792 | 1703 | −62 | −5259 | −6789 | −6576 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 8 | 1079 | −3220 | −3617 | 703 | −3286 | −4113 | −2929 | 1166 | −2924 | −3135 | −2439 | −3170 | −4215 | 389 | −3236 | 1715 | 740 | 1344 | −3665 | −3235 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 9 | −3839 | −4536 | −4390 | −4781 | −6161 | 2644 | −5311 | −6799 | −5903 | −6911 | −6087 | 3381 | −5311 | −5279 | −6157 | −454 | −4274 | −5624 | −6543 | −339 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 10 | 190 | −3905 | 1832 | 1879 | −698 | −3692 | −2363 | −236 | −1989 | −1911 | −3020 | 1391 | −3783 | 1633 | −2477 | −2609 | −1401 | 132 | −4147 | −3526 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 11 | −3090 | 394 | −5376 | −4763 | 441 | −4617 | −3365 | −2413 | −4365 | 247 | 447 | 1605 | 1583 | −3976 | −4169 | −1480 | −3032 | −2337 | −3163 | 3680 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −42 | −10521 | −5148 | −894 | −1115 | −701 | −1378 | * | * | | | | | | | | | | | | |
| 12 | −553 | 1072 | 1339 | −2010 | −4173 | −3638 | −2306 | −3874 | 523 | 1170 | −3032 | −2306 | 1439 | −1873 | 1178 | 228 | 178 | −3506 | −4151 | −557 | 12 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10480 | −11522 | −894 | −1115 | −1531 | −613 | * | * | | | | | | | | | | | | |
| 13 | −2762 | −3129 | 1253 | −2894 | 1755 | 1451 | 1051 | −2726 | −2745 | 139 | −2307 | −863 | −4091 | −357 | −3068 | −1794 | 643 | −568 | −3523 | 2072 | 13 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −35 | −10480 | −5433 | −894 | −1115 | −1531 | −613 | * | * | | | | | | | | | | | | |
| 14 | 344 | −3875 | 1998 | 822 | 229 | 965 | −2306 | −3803 | −1930 | 760 | 639 | −623 | 574 | −1880 | −2421 | −996 | −2566 | −3451 | −4113 | −3485 | 14 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −824 | −10446 | −1203 | −894 | −1115 | −1962 | −428 | * | * | | | | | | | | | | | | |
| 15 | 1093 | −3375 | 458 | 588 | −3695 | 532 | −1535 | −3445 | 89 | −3390 | −2464 | 572 | −2970 | 878 | −1623 | 1141 | 305 | −564 | 1471 | −2876 | 15 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −3 | −9625 | −10667 | −894 | −1115 | −4498 | −65 | * | * | | | | | | | | | | | | |
| 16 | −330 | −3373 | −1752 | 4 | −3693 | 2015 | 922 | −3443 | −1118 | −1414 | −2463 | 1429 | −2971 | 1547 | 494 | 184 | −182 | −2995 | −3558 | −2876 | 16 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −3 | −9625 | −10667 | −894 | −1115 | −4498 | −65 | * | * | | | | | | | | | | | | |
| 17 | −1905 | −3349 | −77 | −1214 | −56 | −2883 | 2651 | −655 | 1592 | 240 | −2442 | 1208 | −2976 | 824 | −156 | −324 | 499 | −2965 | −3540 | −2864 | 17 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −139 | −9625 | −3468 | −894 | −1115 | −4498 | −65 | * | * | | | | | | | | | | | | |
| 18 | −1915 | −2364 | −2497 | −50 | −2406 | −3137 | −1877 | −222 | −29 | −649 | −1540 | −2088 | 3079 | −1690 | −2142 | −382 | 1270 | −220 | −2750 | −2301 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −902 | −9490 | −1109 | −894 | −1115 | −4632 | −59 | * | * | | | | | | | | | | | | |
| 19 | −1317 | −1190 | −3389 | −2773 | −1138 | 192 | −1687 | −689 | −2425 | 393 | −392 | −2386 | 2450 | −2099 | −2321 | −1904 | 594 | 477 | 2075 | 1780 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −6 | −8593 | −9635 | −894 | −1115 | −121 | −3639 | * | * | | | | | | | | | | | | |
| 20 | −1329 | 559 | −74 | −1138 | −3467 | −3819 | −2528 | 69 | −1038 | 345 | −538 | −2648 | 1727 | 863 | −800 | −1226 | 1833 | 834 | −3724 | −3223 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10449 | −11491 | −894 | −1115 | −1931 | −439 | * | * | | | | | | | | | | | | |
| 21 | −986 | 1639 | −1111 | −4552 | 793 | −4393 | −3264 | 523 | −4148 | 1350 | −51 | −4038 | 1636 | −3771 | −3949 | 447 | −983 | 1321 | −3130 | −2788 | 21 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10449 | −11491 | −894 | −1115 | −875 | −1136 | * | * | | | | | | | | | | | | |
| 22 | −1149 | −4091 | 367 | 1318 | −4411 | −3593 | −158 | 838 | 684 | −1244 | −3180 | −826 | 2117 | 866 | −158 | −2500 | 470 | −1964 | −4274 | −3592 | 22 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −34 | −10485 | −5458 | −894 | −1115 | −1452 | −657 | * | * | | | | | | | | | | | | |
| 23 | 1189 | 1358 | 921 | 893 | −669 | −3566 | 1028 | −4127 | 49 | −4074 | −3149 | 602 | −3659 | −1765 | 841 | 703 | −2530 | 734 | −4244 | −3562 | 23 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −35 | −10452 | −5425 | −894 | −1115 | −1898 | −451 | * | * | | | | | | | | | | | | |
| 24 | 1666 | −2652 | −5120 | −4487 | −2607 | −1386 | −3232 | 1176 | −1177 | −548 | −1855 | −3994 | −4413 | −597 | −3908 | −3445 | −1132 | 2273 | 3051 | −2767 | 24 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10419 | −11461 | −894 | −1115 | −2238 | −344 | * | * | | | | | | | | | | | | |
| 25 | 1114 | −2654 | −5077 | −4446 | −2609 | −1385 | −3220 | 1265 | 1372 | 191 | 1424 | −3972 | −4404 | −3698 | 1316 | −3435 | −842 | 974 | 958 | −2767 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10419 | −11461 | −894 | −1115 | −2238 | −344 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | −458 | −4035 | 5 | 1675 | −4356 | −3535 | −30 | −4106 | 2165 | −368 | −3124 | −2171 | −720 | 1540 | 386 | −1419 | −841 | −1264 | −4218 | −3535 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10419 | −11461 | −894 | −1115 | −2238 | −344 | * | * | | | | | | | | | | | | |
| 27 | 2757 | −4029 | −2420 | 643 | −4345 | −3543 | −2201 | −4092 | 882 | −1827 | −3119 | −1044 | −3636 | −242 | 118 | −1030 | −700 | −904 | −4214 | −3535 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10419 | −11461 | −894 | −1115 | −2238 | −344 | * | * | | | | | | | | | | | | |
| 28 | 1215 | −2992 | −3583 | 1614 | 265 | 67 | −505 | 462 | −2849 | 272 | 272 | 1048 | −4092 | −523 | −3128 | −1138 | −131 | −756 | −3400 | −2984 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −82 | −10419 | −4199 | −894 | −1115 | −2238 | −344 | * | * | | | | | | | | | | | | |
| 29 | 391 | −3510 | −2654 | −2102 | −3659 | −3620 | −2306 | 994 | 1462 | −10 | 192 | 763 | 1459 | 1374 | 458 | −1227 | −2488 | −1000 | −3807 | −3249 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −38 | −10338 | −5291 | −894 | −1115 | −2808 | −222 | * | * | | | | | | | | | | | | |
| 30 | −2477 | −3948 | 2013 | 1870 | −4271 | −3448 | −167 | −4020 | 680 | −1003 | −3038 | −2083 | −3541 | 1637 | 1528 | −940 | −2415 | −3571 | −4130 | −668 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −982 | −10302 | −1020 | −894 | −1115 | −3002 | −192 | * | * | | | | | | | | | | | | |
| 31 | 1546 | −3053 | −1562 | −1013 | −3335 | −1134 | 860 | −300 | 959 | −372 | −2152 | 525 | −2758 | 1370 | 285 | −153 | −186 | −347 | −3260 | −2602 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −125 | −9323 | −3619 | −894 | −1115 | −4766 | −54 | * | * | | | | | | | | | | | | |
| 32 | −555 | 1302 | −3880 | −281 | 569 | −3293 | 2019 | −1135 | −2906 | −577 | −838 | −2859 | −3345 | −2573 | −2790 | 1194 | −1713 | 319 | 1995 | 2929 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −97 | −9202 | −3974 | −894 | −1115 | −3995 | −93 | * | * | | | | | | | | | | | | |
| 33 | −2274 | −2862 | −4953 | −5244 | −5187 | 2991 | −4651 | 2038 | −5203 | −5186 | −4371 | −3850 | −3953 | −4728 | −4958 | 1216 | −2734 | −3733 | −5493 | −5332 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1402 | −9175 | −690 | −894 | −1115 | −4865 | −50 | * | * | | | | | | | | | | | | |
| 34 | −1053 | 4440 | −3262 | −2744 | 1190 | 872 | −1540 | −523 | −2386 | 412 | −271 | −2205 | −2628 | −2034 | −2258 | −1575 | −1087 | −467 | −1404 | −891 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −10 | −7783 | −8825 | −894 | −1115 | −5329 | −36 | * | * | | | | | | | | | | | | |
| 35 | −890 | −2239 | −768 | −219 | −2598 | −1834 | −465 | −2305 | 1003 | −2262 | −1374 | 1443 | −1933 | −20 | 922 | 269 | 2281 | −1894 | −2425 | −1809 | 35 |
| — | −149 | −500 | 232 | 42 | −377 | 398 | 105 | −627 | 210 | −465 | −721 | 277 | 395 | 45 | 98 | 359 | 117 | −370 | −295 | −250 | |
| . | −2264 | −341 | −8825 | −38 | −5258 | −5329 | −36 | * | * | | | | | | | | | | | | |
| 36 | −1602 | −3257 | 1762 | 2595 | −3518 | −1991 | −1048 | −3334 | 700 | −3247 | −2420 | −595 | 1376 | −654 | −1555 | −1374 | −1597 | −2857 | −3425 | −2604 | 37 |
| — | −149 | −500 | 233 | 43 | −381 | 400 | 106 | −626 | 210 | −466 | −721 | 275 | 394 | 45 | 96 | 359 | 117 | −369 | −294 | −249 | |
| . | −160 | −3280 | −8825 | −979 | −1021 | −5329 | −36 | * | * | | | | | | | | | | | | |
| 37 | −1104 | −1724 | −2972 | −3274 | −4155 | 3334 | −3201 | −4056 | −3613 | −4271 | −3372 | −2416 | −2706 | −3181 | −3549 | 1317 | −1561 | −2862 | −4294 | −4154 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −10 | −7783 | −8825 | −894 | −1115 | −341 | −2249 | * | * | | | | | | | | | | | | |
| 38 | 1671 | −2983 | −3134 | −69 | 430 | −3769 | 1287 | 1197 | −1161 | 595 | 28 | −640 | −3845 | −250 | 156 | −1093 | −709 | −245 | −3368 | −2919 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10247 | −11289 | −894 | −1115 | −322 | −2323 | * | * | | | | | | | | | | | | |
| 39 | 697 | −4040 | −726 | −41 | −1223 | 1271 | 797 | −1182 | −1136 | 1030 | −3135 | 453 | −3694 | −246 | −511 | 189 | −886 | −606 | −4236 | −501 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10480 | −11522 | −894 | −1115 | −1531 | −613 | * | * | | | | | | | | | | | | |
| 40 | 1535 | −4038 | 1694 | 1009 | −4336 | −3602 | −2263 | −185 | −288 | −277 | 886 | −2247 | −3695 | 61 | −1238 | 714 | −858 | −1823 | −4235 | −3566 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10480 | −11522 | −894 | −1115 | −1531 | −613 | * | * | | | | | | | | | | | | |
| 41 | 57 | 581 | −137 | −1942 | 1249 | 1192 | −58 | −214 | 178 | −1833 | 815 | 837 | −1118 | 824 | −988 | 375 | 264 | −3642 | −4232 | −3564 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10480 | −11522 | −894 | −1115 | −352 | −2208 | * | * | | | | | | | | | | | | |
| 42 | −2650 | −4124 | −367 | 20 | −4445 | 1542 | 1114 | −4195 | −46 | −4140 | −698 | −16 | 533 | 1741 | 1406 | 586 | −1003 | −1444 | −4307 | −3624 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 43 | −382 | −4122 | 729 | 386 | −4443 | 845 | −2283 | −1617 | 291 | −1503 | 100 | 83 | 3 | −267 | −661 | 843 | 1562 | −1360 | −4306 | −3623 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 44 | −489 | 528 | −796 | −752 | 1099 | −1472 | −3228 | 492 | −3861 | 858 | −1997 | 602 | −4438 | −3567 | 1659 | −1537 | 0 | 410 | 1085 | 533 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 45 | 978 | −3946 | −2601 | −2052 | 248 | −1231 | 2259 | −3890 | 1201 | −78 | −374 | 2043 | −3768 | −1914 | −93 | −458 | 533 | −3527 | −4177 | −3544 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 46 | −1352 | −3965 | −2589 | 690 | 218 | 495 | −2337 | 584 | 188 | 502 | −3073 | 1053 | −3762 | 464 | 1167 | −537 | −933 | 83 | −4191 | −3552 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 47 | −2974 | 491 | −5311 | −4685 | 1333 | −1706 | −3358 | −735 | −4281 | −1215 | −2014 | −4157 | −4567 | −3900 | −4081 | −245 | 332 | −2224 | −3201 | 4215 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 48 | −1231 | −2766 | −5031 | −4410 | −529 | 1763 | −3288 | −414 | −4053 | 804 | −1968 | −3999 | 2007 | 1298 | −3930 | −359 | 551 | −1000 | −3221 | −2874 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10521 | −11563 | −894 | −1115 | −701 | −1378 | * | * | | | | | | | | | | | | |
| 49 | −1408 | −4126 | 2230 | −743 | −4447 | −293 | −119 | −4198 | −632 | −4142 | −3215 | 720 | 2357 | −1825 | −542 | −439 | 804 | −3748 | −4309 | −459 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −1 | −10521 | −11563 | −894 | −1115 | −701 | −1378 | * | * | | | | | | | | | | | | |
| 50 | −1228 | 542 | −5145 | −4516 | 837 | −628 | −3308 | 1125 | −4135 | −1045 | 801 | −332 | 704 | 280 | −5 | 280 | 1292 | −1046 | 1149 | 1648 | 53 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 51 | −613 | −4120 | 1796 | 467 | −810 | −770 | 2742 | −344 | −508 | −2162 | −3209 | −1056 | −237 | 863 | 532 | −1320 | −959 | −141 | −4304 | −375 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −355 | −10521 | −2201 | −894 | −1115 | −701 | −1378 | * | * | | | | | | | | | | | | |
| 52 | −2598 | −2433 | −4902 | −4270 | −2388 | 3079 | 69 | 261 | −3875 | 48 | −1637 | −3774 | −4192 | −3506 | −3690 | −1074 | −473 | 213 | −2892 | −288 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −10167 | −11209 | −894 | −1115 | −81 | −4198 | * | * | | | | | | | | | | | | |
| 53 | 243 | −3189 | −375 | −2879 | −642 | −4034 | 3088 | 438 | −2734 | 1213 | −2365 | −519 | −996 | 181 | −814 | 306 | −1175 | −886 | −3580 | 590 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 54 | 899 | −4079 | 602 | −783 | −4380 | −1588 | 173 | −369 | 874 | −170 | −3174 | −706 | 2232 | −335 | −2389 | −2545 | −133 | −141 | −4275 | −278 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 55 | 1200 | 195 | 971 | 2479 | −720 | −3635 | −2295 | −4127 | 123 | −1255 | −3179 | −2277 | −3728 | −337 | −2387 | 348 | −788 | −1524 | −4279 | −3607 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 56 | 75 | −2937 | −5462 | −4830 | 2870 | −4674 | −3523 | −2331 | −4428 | 2223 | −104 | −4318 | −4707 | −4030 | −4222 | −1385 | −3060 | −230 | −3346 | 290 | 59 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 57 | −1350 | −57 | −2517 | 1763 | −4394 | −1734 | −2295 | −273 | 1224 | −943 | −3182 | 513 | −3727 | −364 | 2482 | −2542 | −457 | −1682 | −4282 | −3609 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 58 | −455 | 351 | −324 | 1922 | −4445 | −3624 | 39 | −4196 | 1536 | −4140 | −3213 | 1056 | −3717 | 1280 | −287 | −56 | 620 | −3746 | −4307 | −280 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 59 | 2188 | 896 | −679 | 872 | −4444 | −2006 | −2283 | −4195 | 387 | −86 | −3212 | 168 | −3717 | 268 | 1072 | −1036 | −1167 | −3745 | −4306 | −3624 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 60 | −559 | −2774 | −5299 | −4665 | −2732 | −4506 | −3381 | 2107 | −4262 | 1993 | 135 | −4152 | −4553 | −3886 | −4064 | −603 | 308 | 954 | −3244 | −270 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 61 | 3052 | 392 | −4894 | −4280 | −2741 | −1553 | −3255 | −52 | −1612 | −1595 | 180 | −3930 | −4456 | −1096 | −1328 | −668 | −500 | −1242 | 648 | −2882 | 64 |
| — | −149 | −500 | 232 | 42 | −381 | 398 | 105 | −627 | 210 | −467 | −721 | 277 | 393 | 45 | 98 | 359 | 119 | −370 | −267 | −250 | |
| H | −37 | −5320 | −11563 | −2194 | −356 | −701 | −1378 | * | * | | | | | | | | | | | | |
| 62 | 250 | −4125 | 1305 | 1569 | −4446 | −3625 | 885 | −4197 | 1866 | −2051 | −3214 | −2260 | −1152 | 1295 | 675 | −117 | −2591 | −3747 | −4308 | −3625 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 63 | −6568 | −5769 | −7371 | −7455 | 2910 | −7149 | 253 | −5623 | 502 | 1668 | −5097 | −5889 | −7035 | −5898 | −166 | −6372 | −6438 | −5707 | 2100 | 2473 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 64 | 382 | −2737 | −5254 | −4618 | 1706 | −4457 | 1714 | 493 | −1273 | 1193 | 2114 | −4103 | −4507 | −3836 | −267 | −3542 | −2850 | 230 | 952 | 1630 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 65 | −1599 | −4117 | −2501 | −775 | 1270 | 1989 | 1572 | −4183 | 684 | −498 | −3207 | 1009 | −3719 | 273 | 0 | 27 | −864 | −3737 | −4302 | −836 | 73 |
| — | −149 | −500 | 232 | 43 | −381 | 398 | 105 | −627 | 212 | −466 | −721 | 275 | 393 | 45 | 95 | 361 | 119 | −370 | −295 | −245 | |
| C | −1456 | −5471 | −706 | −2181 | −359 | −701 | −1378 | * | * | | | | | | | | | | | | |
| 66 | −316 | −3938 | −2281 | 403 | −4484 | 2693 | −1933 | −4104 | 2190 | −3937 | −3126 | −2078 | −3542 | −1504 | −30 | −2565 | −2598 | −3712 | −3970 | −3504 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −81 | −9152 | −4239 | −894 | −1115 | −4879 | −50 | * | * | | | | | | | | | | | | |
| 67 | 1559 | −2955 | 1153 | 1329 | −3273 | −2462 | −1122 | −670 | 808 | −2970 | −2045 | 500 | −2556 | 434 | −1211 | −1370 | 692 | −829 | −3140 | −2459 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −4 | −9075 | −10117 | −894 | −1115 | −1498 | −630 | * | * | | | | | | | | | | | | |
| 68 | −692 | −3466 | 1886 | −1295 | −3786 | −263 | −1629 | −3535 | −2 | −1277 | −2555 | 481 | −239 | −1169 | 2440 | −495 | 630 | −3087 | −3650 | −2968 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −3 | −9739 | −10781 | −894 | −1115 | −3291 | −155 | * | * | | | | | | | | | | | | |
| 69 | −2041 | 1927 | 226 | 1172 | −3833 | 940 | 1393 | −538 | −1254 | −3529 | −2602 | −261 | −497 | 483 | −109 | 1511 | −254 | −3135 | −3696 | −3014 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −9798 | −10840 | −894 | −1115 | −3347 | −149 | * | * | | | | | | | | | | | | |
| 70 | −917 | −3569 | −397 | 1431 | −3884 | 92 | 997 | −788 | −1327 | −3583 | −2661 | 1496 | 2051 | −1283 | −1835 | −500 | −2047 | −3188 | −3756 | 1942 | 83 |
| — | −149 | −500 | 232 | 42 | −373 | 399 | 105 | −627 | 210 | −467 | −721 | 275 | 395 | 48 | 95 | 359 | 117 | −370 | −295 | −250 | |
| H | −56 | −4732 | −10887 | −2187 | −358 | −4216 | −80 | * | * | | | | | | | | | | | | |
| 71 | 41 | −3367 | −2031 | −215 | −638 | 940 | −1773 | −3307 | 670 | −58 | −2477 | 662 | −3196 | 150 | 638 | −2019 | 262 | 1028 | −3599 | 1170 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −9845 | −10887 | −894 | −1115 | −4216 | −80 | * | * | | | | | | | | | | | | |
| 72 | −645 | −2190 | −4633 | −4003 | −2153 | −3904 | 761 | 1500 | 732 | 1485 | −1393 | −3526 | −3953 | −3254 | −3439 | −2987 | 1077 | 1645 | −2662 | −2318 | 90 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −9845 | −10887 | −894 | −1115 | −4216 | −80 | * | * | | | | | | | | | | | | |
| 73 | 541 | −3551 | 403 | 837 | −3872 | −3053 | −1711 | −1351 | 1373 | −1456 | −2641 | −314 | 1364 | 1281 | −775 | −57 | 506 | −1305 | −3735 | −3052 | 91 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −9845 | −10887 | −894 | −1115 | −1820 | −481 | * | * | | | | | | | | | | | | |
| 74 | −2408 | −2624 | −182 | 794 | 1709 | −3728 | 486 | 458 | −2617 | 1378 | −1810 | −2839 | −3797 | −307 | −723 | −461 | −506 | 185 | −3039 | 1260 | 92 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10047 | −11089 | −894 | −1115 | −2070 | −392 | * | * | | | | | | | | | | | | |
| 75 | −830 | −3805 | 1765 | 770 | −4126 | −447 | −1964 | −911 | 1626 | −3821 | −2894 | 1209 | −3399 | 965 | −2052 | −941 | 944 | −957 | −3988 | −3305 | 93 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10150 | −11192 | −894 | −1115 | −78 | −4251 | * | * | | | | | | | | | | | | |
| 76 | 844 | −4036 | −2546 | −1997 | −4318 | −3649 | −14 | −4041 | 620 | −2076 | −19 | −430 | 2001 | −507 | 1979 | −271 | −92 | 61 | −4243 | −452 | 94 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 77 | 13 | 352 | 719 | 2363 | −4439 | −1193 | −2284 | −574 | 221 | −4135 | −3209 | −122 | −1231 | 590 | −2372 | 140 | −2590 | 568 | −4304 | −837 | 95 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −819 | −10521 | −1210 | −894 | −1115 | −701 | −1378 | * | * | | | | | | | | | | | | |
| 78 | 1353 | −3303 | 1494 | −1687 | −3806 | 123 | −1975 | −3512 | −1607 | −3556 | −2678 | −1944 | −3287 | −1553 | 1305 | 651 | 938 | 1004 | −3796 | −3178 | 96 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −3 | −9704 | −10747 | −894 | −1115 | −43 | −5085 | * | * | | | | | | | | | | | | |
| 79 | 1397 | −4121 | −789 | 606 | −897 | −204 | −2284 | −4191 | −1864 | −1653 | −3210 | 1624 | −3718 | 1172 | 571 | −309 | 1275 | −3742 | −4305 | −540 | 97 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −10521 | −11563 | −894 | −1115 | −701 | −1378 | * | * | | | | | | | | | | | | |
| 80 | −957 | −3941 | −6899 | −6444 | −4375 | −6425 | −5756 | 1973 | −6226 | 942 | −3275 | −6089 | −860 | −5997 | −6188 | −5644 | −106 | 2826 | −5464 | −5053 | 98 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 81 | −1168 | 1315 | −5268 | −4633 | −627 | −4472 | −3344 | 1420 | −4228 | 1035 | −1949 | −4118 | −4521 | 2315 | −4029 | −3557 | −243 | 1754 | 1912 | −2866 | 99 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 82 | −1199 | 891 | −5255 | −4619 | 2213 | −1095 | −3329 | −824 | −4214 | 477 | 2013 | −4103 | −843 | −3837 | −4014 | −1727 | 1198 | 1461 | −3194 | 1264 | 100 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 83 | −82 | 537 | −5198 | −4566 | −447 | 1589 | −3320 | −212 | −4174 | 631 | −1948 | −900 | 142 | −3807 | −3994 | 1530 | 1053 | −710 | −3202 | −2859 | 101 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 84 | −1001 | −3967 | −2616 | −2068 | −4239 | 1511 | −2364 | −3943 | −1977 | −3974 | 71 | 1025 | 982 | −225 | −743 | 2052 | 182 | −43 | −4214 | −3577 | 102 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 85 | −3631 | 1866 | −926 | −6083 | −6922 | 3647 | −5972 | −6773 | −6605 | −7006 | −6055 | −5047 | −5279 | −5980 | −6447 | −1096 | −4104 | −5461 | −7115 | −7019 | 103 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 86 | 1655 | 543 | −5439 | −4870 | 1419 | −24 | −3649 | −2617 | −4483 | −2971 | −2319 | −4276 | −4644 | −4111 | −4301 | 1258 | 1771 | −763 | −3568 | 1775 | 104 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 87 | −96 | 545 | 1701 | −1972 | −4382 | 1669 | 180 | −993 | 921 | −1838 | −3175 | 256 | −3729 | −176 | −2389 | −108 | 648 | −813 | −4276 | −3605 | 105 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −21 | −10521 | −6155 | −894 | −1115 | −701 | −1378 | * | * | | | | | | | | | | | | |
| 88 | 2212 | −4114 | −2489 | 1541 | −4433 | 284 | 1030 | −4181 | −1870 | −4131 | −3208 | −2260 | −955 | 720 | −2377 | 738 | −856 | −3736 | −4303 | −170 | 106 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10501 | −11543 | −894 | −1115 | −471 | −1845 | * | * | | | | | | | | | | | | |
| 89 | 1211 | 118 | −5249 | −4614 | −2699 | 467 | −3334 | 637 | −4212 | 1076 | 465 | 2020 | −4512 | −3838 | −4017 | −563 | −2856 | 916 | −3203 | −2861 | 107 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 90 | −487 | −3851 | −343 | −2115 | −4060 | −1403 | −522 | 2077 | −841 | 805 | −2971 | 556 | −846 | −374 | 1648 | −1033 | −2620 | −316 | 428 | −3498 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 91 | 160 | −3576 | 756 | 1013 | 508 | 369 | −2513 | −136 | −2240 | 356 | −2722 | −612 | −3903 | 958 | −2682 | 148 | −1115 | 409 | −3893 | 513 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 92 | 1309 | −2790 | −4836 | −1088 | −896 | 221 | 3 | −31 | −3903 | 869 | 248 | −289 | −4447 | −623 | −3845 | −534 | 1199 | 839 | −3240 | −238 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 93 | 1742 | 1506 | −5264 | −4629 | 304 | −1002 | −3340 | 1070 | −4224 | 1889 | −1948 | −4113 | −4516 | −3847 | −4024 | −1457 | −1552 | 107 | −3205 | −2863 | 111 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |

-continued

| 94 | −233 | 531 | 1027 | 435 | 1333 | −1743 | −2835 | 1393 | −1049 | −30 | 1338 | −712 | 573 | −2723 | −3155 | −671 | 199 | −1024 | −3527 | −3101 | 112 |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 95 | 697 | −2785 | −4873 | −4260 | 2638 | −1473 | −3250 | −758 | −3931 | −221 | 1430 | −3919 | −4453 | 1157 | 1656 | −1373 | 834 | −2202 | −3236 | −2884 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 96 | 1205 | 2847 | −5256 | −4620 | 396 | −1360 | −3330 | 810 | −4215 | 1643 | 227 | −4105 | −4509 | 165 | −4016 | −3544 | −174 | 261 | −3196 | −2854 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 97 | 1152 | 398 | −5205 | −1751 | 1489 | −912 | −3319 | −79 | −141 | 1266 | 1054 | −4080 | −4501 | −1102 | −3995 | −162 | 310 | −800 | 1150 | −267 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −898 | −10521 | −1112 | −894 | −1115 | −701 | −1378 | * | * | | | | | | | | | | | | |
| 98 | −459 | 2585 | −14 | −1202 | −3695 | 199 | 736 | −3445 | 1316 | −3390 | −2464 | −1513 | −60 | 194 | 2190 | −592 | 320 | −2996 | −3558 | −2876 | 116 |
| — | −149 | −500 | 232 | 43 | −381 | 399 | 105 | −627 | 210 | −466 | −721 | 277 | 393 | 45 | 95 | 359 | 119 | −370 | −285 | −246 | |
| H | −711 | −4865 | −1495 | −2153 | −368 | −40 | −5175 | * | * | | | | | | | | | | | | |
| 99 | 1288 | 1592 | −3961 | −950 | 1191 | −1111 | 597 | 563 | −350 | 1222 | −1827 | −84 | −4058 | −746 | −3277 | −833 | −2528 | −727 | −3068 | 562 | 122 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10216 | −11258 | −894 | −1115 | −2422 | −298 | * | * | | | | | | | | | | | | |
| 100 | −1041 | −3505 | 1338 | 473 | 1065 | −1093 | −2196 | −1214 | −1866 | −907 | 891 | 2637 | 601 | −1809 | −2334 | −1199 | −304 | −3044 | −3786 | −824 | 123 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10251 | −11293 | −894 | −1115 | −100 | −3902 | * | * | | | | | | | | | | | | |
| 101 | 544 | −4123 | −753 | −827 | −4444 | 276 | 1136 | −1307 | 980 | −4139 | −3212 | −2261 | 2828 | −1824 | 172 | −621 | −42 | −3745 | −4307 | −3624 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 102 | −1485 | −4137 | 250 | 483 | −1246 | 2780 | 371 | −4208 | 1245 | −4153 | −3227 | −2270 | −3730 | 97 | −2387 | −424 | −2605 | −1713 | −4321 | −3638 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −42 | −10521 | −5148 | −894 | −1115 | −701 | −1378 | * | * | | | | | | | | | | | | |
| 103 | −1419 | 1762 | 2916 | 382 | −4409 | −3591 | −2250 | −4159 | −886 | −2094 | −3178 | −2227 | −3685 | 282 | 986 | 936 | −249 | −3711 | −4273 | −3590 | 126 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2 | −10480 | −11522 | −894 | −1115 | −1531 | −613 | * | * | | | | | | | | | | | | |
| 104 | 875 | −4079 | −816 | 868 | −4397 | 343 | −2250 | −41 | 274 | −407 | −3170 | 619 | 274 | 162 | 723 | −2497 | −103 | 102 | −4265 | −385 | 127 |
| — | −149 | −500 | 235 | 43 | −381 | 399 | 106 | −626 | 210 | −466 | −720 | 275 | 394 | 45 | 96 | 359 | 117 | −369 | −294 | −249 | |
| E | −28 | −5741 | −11522 | −205 | −2913 | −352 | −2208 | * | * | | | | | | | | | | | | |
| 105 | 0 | −4038 | −7058 | −6631 | 1332 | −6667 | −6090 | 2831 | −6452 | −892 | −3362 | −6318 | −6523 | −6252 | −6450 | −5914 | −1105 | 2323 | −5738 | −5313 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 106 | −443 | −3026 | −5560 | −4933 | 851 | −4782 | −3616 | 1350 | −4534 | 1897 | −2066 | −4422 | −4806 | −4131 | −4327 | −3873 | −3157 | 1302 | 3142 | 1078 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 107 | 41 | −2737 | −5252 | −1314 | −625 | −1399 | −3328 | 1967 | −4211 | 317 | 968 | −4102 | −4507 | −3835 | −4013 | 998 | −897 | 1846 | −3194 | −265 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 108 | −1200 | 1375 | 1997 | −3160 | 893 | −1610 | 386 | −3181 | −3053 | −1711 | −2738 | −3253 | 2974 | −2926 | −3387 | 605 | −2955 | −2997 | −3944 | −3504 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 109 | 1151 | −4123 | 1494 | 393 | −4444 | −1193 | −2283 | −767 | −180 | −2025 | −3212 | 397 | 364 | −300 | 11 | 536 | 1001 | −1693 | −4306 | −3624 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10521 | −11563 | −894 | −1115 | −701 | −1378 | * | * | | | | | | | | | | | | |
| 110 | −2979 | −2807 | −5291 | −4661 | −2700 | −1709 | −3368 | −841 | −4254 | 544 | −1987 | −4154 | 3717 | −551 | −4063 | −3606 | −2920 | −929 | 866 | −300 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 111 | −1059 | −3138 | −4757 | −4218 | −528 | 490 | −3538 | −2850 | −3970 | −3185 | −2516 | 1431 | −4565 | −3724 | −4035 | 1258 | 2316 | −190 | −3750 | 2290 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 112 | −7183 | −6090 | −7545 | −7907 | 1944 | −7429 | 3149 | −6066 | −7462 | −5368 | −5466 | −6034 | −7282 | −6176 | −6820 | −1393 | −7030 | −6223 | 4459 | 3377 | 136 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10521 | −11563 | −894 | −1115 | −701 | −1378 | * | * | | | | | | | | | | | | |
| 113 | 1463 | −3883 | 101 | −372 | −4105 | 884 | −2382 | −3787 | −2016 | −1624 | −3004 | −2394 | 2063 | −1965 | −2501 | 1065 | −264 | −640 | −4135 | −398 | 137 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 114 | 131 | −3797 | −2705 | −36 | 29 | −374 | 195 | −1363 | −2058 | −1721 | 1855 | 2006 | −848 | 453 | −2533 | 1854 | −2627 | −3348 | −4065 | −353 | 138 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 115 | −4184 | −3916 | −6345 | −5834 | 1730 | −5671 | 3377 | 398 | −5438 | −698 | 1765 | −5160 | −5630 | −4884 | −5170 | −4785 | −4112 | −989 | −3347 | 3507 | 139 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 116 | −2 | −4121 | 385 | −193 | −4442 | −1312 | −170 | 1260 | 1127 | −937 | −3211 | 682 | 531 | −197 | −695 | 341 | −29 | −569 | −4305 | −189 | 140 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 117 | −731 | −4123 | 1033 | 802 | −4444 | −1698 | 252 | −1346 | −134 | −1773 | 60 | 892 | 270 | 150 | 1432 | −521 | 674 | 363 | −4306 | −3624 | 141 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 118 | 461 | 392 | 879 | −4281 | −2741 | 1267 | −3255 | 1698 | −3949 | −755 | −36 | 124 | −4456 | −795 | −3870 | −19 | −2836 | 973 | −3233 | 477 | 142 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 119 | 1290 | 2679 | −5526 | −4901 | 2214 | −4751 | −3638 | 1490 | −4507 | 800 | −2106 | −4398 | −4783 | −4126 | −4310 | −3844 | −3108 | 1067 | 459 | −3142 | 143 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 120 | −228 | −4123 | −2498 | 1257 | −4444 | −1456 | −2283 | −1617 | 1497 | −4139 | −3213 | 935 | −3718 | 831 | 2432 | −1122 | −363 | −1276 | −4307 | −3624 | 144 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 121 | 732 | −2858 | −82 | −3854 | −2829 | 63 | −231 | 656 | −3596 | 1758 | 309 | −905 | −4376 | −3355 | −1237 | −697 | −925 | −2281 | 2951 | 443 | 145 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 122 | 1650 | 2229 | −3418 | −1016 | −3234 | −1735 | 202 | −933 | −2712 | −1510 | 157 | 1009 | −4101 | −2600 | 1197 | 1115 | −883 | −1346 | −3590 | 1022 | 146 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 123 | −2667 | −4141 | −154 | −951 | −4462 | 2661 | 249 | −4213 | 297 | −4156 | −3230 | −2272 | −1012 | 858 | 1128 | −778 | 675 | −3763 | −4323 | −3640 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 124 | 926 | 1264 | −5253 | −4617 | 1104 | 1616 | −3328 | 750 | −4212 | 281 | 675 | −4102 | −4507 | −3836 | 173 | −466 | −899 | 709 | −3194 | −2852 | 148 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 125 | 131 | −4123 | −112 | 1879 | −4444 | −486 | −2283 | −1994 | 1493 | −4139 | −3212 | −2260 | 880 | 235 | −751 | −1540 | 836 | 311 | −4306 | −3624 | 149 |
| — | −150 | −501 | 234 | 46 | −381 | 398 | 105 | −627 | 211 | −467 | −721 | 278 | 393 | 50 | 95 | 358 | 116 | −370 | −295 | −250 | |
| E | −230 | −2766 | −11563 | −31 | −5557 | −701 | −1378 | * | * | | | | | | | | | | | | |
| 126 | −1199 | 544 | −5251 | −4615 | 741 | −4457 | −3328 | 1220 | −655 | 386 | 261 | −4101 | 671 | −1105 | −326 | −3541 | −969 | 2303 | 1689 | −2852 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 127 | −1398 | −2953 | −907 | −3475 | 126 | −4223 | 139 | 1282 | −72 | −1969 | 1027 | −3440 | −4288 | 402 | 1635 | −251 | −2787 | 1690 | −3380 | 1550 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 128 | −2662 | −4012 | −2560 | 751 | −31 | −3656 | −18 | −634 | −130 | −1099 | −3115 | −665 | 1163 | 375 | 1309 | −148 | 1022 | −56 | −4226 | 1677 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 129 | −1229 | 399 | −5257 | −4621 | 1726 | −1399 | −3330 | 901 | −4216 | −2586 | 338 | −4105 | −4509 | −3839 | −4016 | −3543 | −966 | 1867 | 525 | 3324 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 130 | 1053 | −4123 | −972 | 309 | −4444 | −3624 | 1890 | −4195 | 243 | −1935 | −772 | 1101 | 2255 | −1823 | 1201 | −754 | −1416 | −3745 | −4307 | −3624 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −426 | −10521 | −1972 | −894 | −1115 | −701 | −1378 | * | * | | | | | | | | | | | | |
| 131 | −951 | 3398 | −4877 | −4241 | −348 | −4079 | −2950 | −300 | −3835 | 1423 | −1560 | −3725 | −4129 | −3458 | −607 | −3164 | 96 | 201 | 1089 | 2740 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −10097 | −11139 | −894 | −1115 | −3719 | −114 | * | * | | | | | | | | | | | | |
| 132 | −1236 | −3728 | 453 | 534 | −693 | −3269 | 612 | −3775 | 51 | −592 | −2821 | 308 | −3362 | −1474 | 799 | 42 | 846 | −1165 | 736 | 2730 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −361 | −10097 | −2182 | −894 | −1115 | −3719 | −114 | * | * | | | | | | | | | | | | |
| 133 | −231 | −3465 | 1999 | −33 | −3785 | −2968 | 488 | −3535 | 761 | −3481 | −2555 | −1604 | 1146 | 124 | −1715 | 1632 | −1934 | −785 | 1473 | −2967 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −3 | −9738 | −10781 | −894 | −1115 | −4365 | −72 | * | * | | | | | | | | | | | | |
| 134 | 885 | 76 | −97 | 1765 | −3772 | −2992 | −1662 | −794 | −1252 | −3475 | −2559 | −1635 | 1647 | 524 | −1758 | 1604 | −1963 | −3078 | −3657 | −2982 | 159 |
| — | −148 | −502 | 235 | 46 | −383 | 398 | 104 | −628 | 211 | −466 | −722 | 276 | 392 | 47 | 102 | 357 | 118 | −371 | −296 | −251 | |
| T | −279 | −2511 | −10781 | −1801 | −488 | −1288 | −760 | * | * | | | | | | | | | | | | |
| 135 | −15 | −3893 | 1846 | 1391 | −4210 | −1108 | −2029 | −3965 | 1126 | −3907 | −2986 | 2118 | 724 | −56 | −2143 | −991 | −2351 | −3513 | −4075 | −3384 | 170 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10097 | −11139 | −894 | −1115 | −3719 | −114 | * | * | | | | | | | | | | | | |
| 136 | −2610 | −4114 | 2136 | −370 | −4426 | 1186 | −2209 | −4187 | −670 | −4126 | −3214 | 2278 | −3616 | −1761 | −777 | 569 | 970 | −3733 | −4295 | −3589 | 171 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −42 | −10097 | −5187 | −894 | −1115 | −3719 | −114 | * | * | | | | | | | | | | | | |
| 137 | −2450 | 497 | −3792 | −3208 | 3092 | −134 | 110 | −701 | −274 | −2368 | 521 | −574 | −3915 | −421 | 243 | −2883 | −2390 | −1936 | 3633 | 979 | 172 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10057 | −11099 | −894 | −1115 | −208 | −2898 | * | * | | | | | | | | | | | | |
| 138 | −1444 | −4088 | −2462 | 393 | −541 | 725 | 3060 | −4159 | 1127 | −1698 | −3177 | 153 | −3682 | 1560 | 178 | 63 | 307 | −3709 | −4271 | −3588 | 173 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10480 | −11522 | −894 | −1115 | −1531 | −613 | * | * | | | | | | | | | | | | |
| 139 | −460 | 1607 | −5206 | −4571 | −840 | −1369 | 202 | 1773 | −4168 | 1388 | 177 | 1693 | −896 | −611 | −3973 | −3503 | −2813 | 887 | −3158 | −2816 | 174 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −10480 | −11522 | −894 | −1115 | −352 | −2208 | * | * | | | | | | | | | | | | |
| 140 | −3545 | −4834 | 3599 | −2630 | −5125 | −4273 | −3036 | −1459 | −1106 | −1960 | −3982 | 53 | −4472 | −2629 | −970 | −3421 | 1523 | −4447 | −5008 | −4393 | 175 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10521 | −11563 | −894 | −1115 | −701 | −1378 | * | * | | | | | | | | | | | | |
| 141 | 572 | −2737 | −5247 | −4612 | 2143 | −4456 | −3327 | 155 | −598 | 724 | 2379 | −4100 | −1297 | −1311 | −1637 | −2096 | −1047 | 1403 | 441 | −298 | 176 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 142 | −815 | −4124 | 2081 | 1826 | −4445 | −1142 | −36 | −4196 | 423 | −4140 | −3213 | 189 | −349 | 1437 | −2371 | −827 | −335 | −41 | −4308 | −3625 | 177 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 143 | 1892 | −4143 | 1569 | −120 | −4464 | 1034 | 1808 | −4215 | 446 | −1775 | −3233 | −743 | −3733 | 892 | −2391 | −999 | −2608 | −3765 | −4327 | −3643 | 178 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 144 | −350 | −3050 | −5587 | −4952 | 175 | −4805 | −3668 | 956 | −4553 | 2475 | 1709 | −4452 | −4821 | −4142 | −4342 | −3895 | −3177 | 439 | 828 | 475 | 179 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 145 | −536 | 1226 | 626 | 2225 | −4228 | −3668 | −2334 | 286 | 151 | 785 | −378 | −2332 | −3759 | 137 | −741 | −1107 | −38 | −1490 | −4196 | −3556 | 180 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 146 | 1140 | 542 | 799 | 1278 | −4444 | −1456 | −2283 | −752 | 37 | −4139 | −3212 | 823 | −893 | 46 | 1106 | −185 | 187 | −3745 | −66 | −421 | 181 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −110 | −10521 | −3785 | −894 | −1115 | −701 | −1378 | * | * | | | | | | | | | | | | |
| 147 | 2120 | −3826 | 1153 | −1973 | −4061 | −1479 | −2260 | −1211 | 995 | 814 | −2939 | −2266 | −3681 | −298 | −689 | −1324 | −193 | −963 | −4063 | −3437 | 182 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10412 | −11454 | −894 | −1115 | −2293 | −329 | * | * | | | | | | | | | | | | |
| 148 | −4599 | −4218 | −7029 | −6476 | −3493 | −6492 | −5400 | 2205 | −1200 | 2405 | −2418 | −6139 | −6235 | −5596 | −5931 | −5678 | −4530 | −196 | −4785 | 2087 | 183 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10412 | −11454 | −894 | −1115 | −2293 | −329 | * | * | | | | | | | | | | | | |
| 149 | 69 | −4030 | 1490 | 1155 | −4351 | −434 | −2189 | −4102 | 1670 | −1639 | −3120 | 186 | −3624 | −1729 | 833 | 301 | 649 | −3652 | −4214 | −3531 | 184 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −81 | −10412 | −4215 | −894 | −1115 | −2293 | −329 | * | * | | | | | | | | | | | | |
| 150 | −740 | −3962 | 660 | 1834 | −4283 | −1398 | −2120 | −4033 | 1749 | −3978 | −3051 | 422 | −265 | 388 | 326 | 702 | −97 | −3584 | −4145 | −3462 | 185 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −396 | −10333 | −2062 | −894 | −1115 | −2839 | −217 | * | * | | | | | | | | | | | | |
| 151 | 2243 | 912 | 271 | −2000 | −270 | −1679 | 720 | −17 | −1883 | 50 | −2090 | −192 | 523 | 96 | −2296 | −71 | −2180 | −2423 | −3278 | −2779 | 186 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −125 | −9939 | −3613 | −894 | −1115 | −4060 | −89 | * | * | | | | | | | | | | | | |
| 152 | −8 | 957 | −489 | −1427 | −3656 | −3066 | 1629 | −565 | −551 | −1785 | −2499 | −1727 | 2293 | 1841 | −177 | 457 | −193 | −714 | −3613 | −2968 | 187 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −109 | −9817 | −3801 | −894 | −1115 | −4259 | −77 | * | * | | | | | | | | | | | | |
| 153 | 369 | −3418 | −1830 | 2165 | −3727 | 138 | −1610 | −3470 | 472 | −1441 | −2510 | −1590 | 1189 | 644 | −1700 | −86 | −675 | −599 | −3608 | 182 | 188 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −3 | −9710 | −10752 | −894 | −1115 | −4401 | −70 | * | * | | | | | | | | | | | | |
| 154 | 207 | −3443 | 319 | −90 | −546 | 1945 | 562 | −3514 | 407 | −1099 | −2532 | 688 | −3037 | 1006 | 752 | −401 | −1909 | −3065 | −3626 | −2943 | 189 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −3 | −9710 | −10752 | −894 | −1115 | −4401 | −70 | * | * | | | | | | | | | | | | |
| 155 | −222 | −3441 | 1177 | 24 | −164 | 685 | −1605 | −3510 | −1187 | −3457 | −2531 | 1949 | −3040 | 352 | 437 | 1221 | −1912 | −93 | −3626 | −2944 | 190 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −3 | −9710 | −10752 | −894 | −1115 | −4401 | −70 | * | * | | | | | | | | | | | | |
| 156 | 622 | −2145 | −441 | −3168 | 594 | −3615 | −2440 | 1589 | 176 | 123 | −1342 | −2990 | 823 | 1478 | −2965 | −2661 | −2107 | 1353 | −2588 | −2222 | 191 |
| — | −149 | −503 | 230 | 45 | −383 | 396 | 103 | −625 | 214 | −464 | −723 | 282 | 398 | 46 | 96 | 356 | 117 | −372 | −283 | −252 | |
| E | −1940 | −2913 | −721 | −2692 | −243 | −43 | −5078 | * | * | | | | | | | | | | | | |
| 157 | −804 | −3752 | −2174 | 952 | −4096 | 48 | −1886 | −3828 | 2419 | −1418 | −2844 | −1905 | 983 | 233 | 1858 | −2191 | −2242 | −3388 | −3903 | −3256 | 199 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −9909 | −10951 | −894 | −1115 | −3057 | −185 | * | * | | | | | | | | | | | | |
| 158 | −646 | 1937 | −2306 | −345 | −3374 | −3285 | 1622 | 396 | −257 | −3161 | −2352 | −235 | 376 | −1594 | 533 | −2214 | 2058 | 1253 | −3507 | −2941 | 200 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9960 | −11003 | −894 | −1115 | −1810 | −484 | * | * | | | | | | | | | | | | |
| 159 | −838 | 653 | −418 | −1629 | −4041 | −130 | −1954 | −841 | 3136 | −3747 | −2833 | −1937 | −3386 | 70 | 250 | −840 | −578 | −1006 | −3934 | −3263 | 201 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10121 | −11163 | −894 | −1115 | −73 | −4332 | * | * | | | | | | | | | | | | |
| 160 | −496 | 537 | −5270 | −4635 | 1378 | 1026 | −3345 | 1138 | −4230 | 840 | 1624 | −4119 | −4522 | −3852 | −4030 | −3558 | −2864 | 1858 | 1504 | −2867 | 202 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 161 | −5585 | −5013 | −8106 | −7619 | 52 | −7928 | −6972 | 2097 | −7484 | 1535 | 1736 | −7624 | −7165 | −6517 | −7147 | −7308 | −5490 | 2447 | −5598 | −5721 | 203 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 162 | 126 | 572 | −5302 | −4667 | 1409 | −4507 | −3377 | 1677 | −4263 | 1583 | −1966 | −4152 | −4554 | −3884 | −4063 | −3592 | −2895 | 1652 | 956 | 629 | 204 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 163 | −524 | −2751 | −5268 | −4633 | 1246 | −4474 | 3060 | 1471 | −4229 | 570 | −1951 | −4119 | −4523 | −1368 | −4030 | −3559 | 1283 | 1401 | −3212 | −2869 | 205 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 164 | 1238 | 2407 | −68 | 1462 | −4501 | −412 | −2402 | −4243 | −2000 | −4209 | −3296 | 1734 | −1154 | −1951 | −2507 | −2631 | 1709 | −1153 | −4394 | −3721 | 206 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 165 | −3522 | 3531 | −6496 | −6709 | −6660 | 867 | −5985 | −6475 | −6528 | −6733 | −5796 | 2463 | −5216 | −6035 | −6280 | 2094 | 462 | −5272 | −6901 | −295 | 207 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 166 | 380 | 2749 | −6712 | −6252 | −4217 | −5950 | −5396 | −457 | −5985 | −872 | −3180 | −5770 | 3373 | −5699 | −5890 | −5168 | −4138 | 1348 | −5169 | −4790 | 208 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 167 | −2799 | −564 | −914 | −2156 | 1913 | −643 | 3653 | −3991 | −2108 | −4032 | −3174 | 1652 | −3884 | −177 | −2602 | 1400 | −2742 | −3636 | −4210 | 143 | 209 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10521 | −11563 | −894 | −1115 | −701 | −1378 | * | * | | | | | | | | | | | | |
| 168 | −610 | −4432 | −4572 | −4949 | −6846 | −4492 | 286 | −6780 | −5902 | −6952 | −6058 | 3954 | −5265 | −5350 | −6083 | 1483 | −4187 | −5550 | −7038 | −6688 | 210 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 169 | −1352 | −4234 | −5864 | −6213 | −6776 | −4467 | −5933 | −6637 | −6392 | −6854 | 2889 | −682 | 3923 | −5947 | −6221 | −3854 | −4081 | −5399 | −7002 | −6858 | 211 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 170 | −3020 | 1899 | 1467 | −1156 | −3249 | −4288 | −3241 | −835 | −3484 | 204 | −2448 | −3534 | −4438 | −3275 | −3691 | −124 | 3114 | −2661 | −3685 | −3292 | 212 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 171 | −663 | −4957 | −7140 | −7507 | −7496 | 3782 | −6740 | −7514 | −7451 | −7655 | −6800 | −6036 | −5964 | −6951 | −7058 | −4710 | −4922 | −6247 | −7264 | −7640 | 213 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10521 | −11563 | −894 | −1115 | −701 | −1378 | * | * | | | | | | | | | | | | |
| 172 | 488 | −3322 | 1044 | −2657 | −901 | −1612 | −2673 | 359 | 407 | −898 | 14 | −2841 | −4028 | −462 | −704 | 596 | 1853 | 721 | −3689 | −3217 | 214 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10521 | −11563 | −894 | −1115 | −701 | −1378 | * | * | | | | | | | | | | | | |
| 173 | 1133 | −2774 | 1767 | −4329 | −2733 | −4411 | −3266 | 1021 | −1334 | 456 | −411 | −859 | −4464 | −3666 | −3892 | −1373 | −386 | 1731 | −3227 | −233 | 215 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −1 | −10521 | −11563 | −894 | −1115 | −701 | −1378 | * | * | | | | | | | | | | | | |
| 174 | 1520 | 573 | −5255 | −4619 | 1239 | −4457 | −3329 | −78 | −4214 | 1269 | 405 | −4103 | 1545 | −3837 | −4014 | −1882 | −897 | −797 | 1151 | 1139 | 216 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10521 | −11563 | −894 | −1115 | −701 | −1378 | * | * | | | | | | | | | | | | |
| 175 | −1076 | −4228 | 1404 | −2027 | −4561 | −3698 | −2388 | −4313 | −145 | −4257 | −3335 | 1229 | 2004 | −1932 | −1064 | 1214 | 1925 | −3861 | −4425 | −3738 | 217 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10521 | −11563 | −894 | −1115 | −701 | −1378 | * | * | | | | | | | | | | | | |
| 176 | −41 | 698 | −3166 | 69 | −1319 | −3930 | 769 | −530 | 547 | 1388 | −2520 | −845 | 1441 | −2395 | 1574 | −2888 | −1022 | −1113 | −3716 | −3237 | 218 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 177 | 954 | −4138 | 1394 | 2285 | −4458 | −1309 | −2294 | −4210 | 946 | −4154 | −3227 | −106 | 508 | −299 | −725 | −467 | −2603 | −3760 | −4321 | −3637 | 219 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 178 | −1430 | −4128 | 1567 | 2148 | −724 | −1391 | 1075 | −4199 | −15 | −1935 | −3217 | −2264 | −3722 | 2348 | −2377 | −2536 | 774 | −3750 | −4311 | −3629 | 220 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 179 | −5029 | −4639 | −7259 | −6734 | −525 | −6709 | −4962 | 1405 | −6397 | 2191 | −2443 | −6239 | −6401 | −5626 | −6059 | −5878 | −4931 | 895 | 4069 | 517 | 221 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 180 | −1117 | 2062 | −933 | 1498 | −4432 | −3626 | 174 | −4180 | 1319 | −339 | −222 | −1020 | −3720 | 1052 | 1111 | −2533 | 229 | 697 | −4301 | −3620 | 222 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 181 | 611 | −4123 | 1406 | 1372 | −4444 | −3624 | −2283 | −1002 | 1898 | −2359 | −698 | −1124 | −1287 | 1005 | −903 | −1663 | 861 | −3745 | −4307 | −3624 | 223 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 182 | −1471 | −4643 | −7625 | −7121 | −583 | −7259 | −6333 | 2471 | −6915 | 2086 | 1048 | −6931 | −6804 | −6215 | −6677 | −6526 | −5048 | 1419 | −5402 | −5360 | 224 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −373 | −10521 | −2139 | −894 | −1115 | −701 | −1378 | * | * | | | | | | | | | | | | |
| 183 | 1913 | −2405 | −4917 | −4281 | −717 | −1027 | −2995 | 195 | −3877 | 1576 | −71 | −3768 | −4174 | −3501 | −509 | −808 | −867 | 889 | −2862 | 103 | 225 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10150 | −11192 | −894 | −1115 | −3574 | −127 | * | * | | | | | | | | | | | | |
| 184 | 903 | −3811 | 1984 | 1667 | −4132 | −3309 | −1969 | −3883 | 207 | −3827 | −2901 | −175 | −3403 | 1182 | 410 | −224 | 348 | −3433 | −3994 | −3311 | 226 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10150 | −11192 | −894 | −1115 | −3574 | −127 | * | * | | | | | | | | | | | | |
| 185 | −866 | −2422 | −4768 | −4142 | 1957 | −4103 | 312 | 1089 | −1001 | 1409 | −1624 | −671 | −4155 | −3421 | 329 | −976 | −667 | 1402 | −2877 | −2532 | 227 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10150 | −11192 | −894 | −1115 | −78 | −4251 | * | * | | | | | | | | | | | | |
| 186 | 1506 | 2123 | −5154 | −4524 | −881 | −4443 | −3309 | 600 | 283 | −445 | −85 | −988 | −1162 | 264 | −3976 | −276 | 345 | 1423 | 760 | −2859 | 228 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 187 | 64 | −4123 | 614 | 430 | −4444 | −3624 | −36 | −4195 | 1688 | −1187 | −312 | 967 | −124 | 1146 | 1166 | −2531 | −119 | −614 | −4306 | −500 | 229 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −100 | −10521 | −3910 | −894 | −1115 | −701 | −1378 | * | * | | | | | | | | | | | | |
| 188 | 917 | −4042 | −700 | 1834 | −4364 | −1259 | −2201 | −4114 | 1722 | −4058 | −3132 | −2178 | −3636 | 978 | 1506 | 84 | −2508 | −3665 | 746 | −3543 | 230 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −160 | −10422 | −3266 | −894 | −1115 | −2211 | −351 | * | * | | | | | | | | | | | | |
| 189 | −935 | −3854 | −2345 | −1793 | −612 | −3447 | 3248 | −3872 | 1533 | −768 | −2952 | 1050 | −3539 | −93 | 843 | −760 | −2401 | −3461 | −4051 | 2345 | 231 |
| — | −149 | −500 | 232 | 43 | −381 | 398 | 105 | −627 | 212 | −466 | −721 | 275 | 399 | 45 | 95 | 359 | 117 | −370 | −295 | −250 | |
| T | −159 | −3263 | −11306 | −51 | −4844 | −104 | −3850 | * | * | | | | | | | | | | | | |
| 190 | −2653 | 392 | −356 | −271 | −1226 | 1540 | 1409 | −4197 | 1436 | −4141 | −3215 | 2563 | −935 | −1825 | 325 | −959 | −2592 | −3747 | −4309 | −3626 | 233 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 191 | 966 | 573 | −5254 | −4618 | −398 | 387 | 612 | 1602 | −4213 | 692 | 191 | −4103 | −4507 | −3836 | −1145 | −554 | −133 | 1140 | 1381 | −2852 | 234 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 192 | −2915 | −2741 | −5260 | −4624 | 412 | −4462 | 2443 | 1374 | −4219 | 1587 | 953 | −4108 | −88 | −3841 | 73 | −3547 | −2855 | 278 | 2186 | 1133 | 235 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 193 | −1000 | −3706 | −6513 | −5990 | −3918 | −5888 | −5024 | 900 | −5693 | 1967 | −2929 | −5563 | 1816 | −5381 | −5575 | −5053 | −13 | 1883 | −4791 | −4427 | 236 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 194 | −5210 | −4777 | −7597 | −7005 | 2492 | −7100 | −5883 | 1388 | −6717 | 1524 | 1628 | −6771 | −6627 | −5876 | −6368 | −6309 | −5103 | 1801 | −4975 | 379 | 237 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 195 | −476 | 1508 | −5261 | −4625 | 1641 | −4464 | 207 | 1004 | −4220 | −41 | −1945 | −4110 | −4514 | −3843 | −4021 | 1138 | −1201 | 2302 | −3201 | −2859 | 238 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 196 | −5803 | −7089 | 4177 | −3842 | −7724 | −5441 | −5063 | −7999 | −5571 | −7753 | −7293 | −885 | −6032 | −4820 | −6485 | −5471 | −5945 | −7410 | −7366 | −6829 | 239 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 197 | −2930 | −3007 | 929 | 3182 | 939 | −4317 | −3124 | −965 | −3413 | −1559 | 1290 | −3556 | −4381 | −3212 | −3575 | −569 | −2871 | −1193 | −3441 | −3059 | 240 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 198 | 2874 | −3559 | −6292 | −5795 | −3871 | −5337 | −4734 | 2016 | −5463 | −3399 | 712 | −5216 | −5502 | −5132 | −5312 | −1509 | −942 | 537 | −4590 | −4229 | 241 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 199 | −7184 | −6092 | −7544 | −7906 | 642 | −7428 | 3344 | −6069 | −7462 | −5370 | −5469 | −6035 | −7283 | −6177 | −6821 | −6679 | −7033 | −6226 | −2853 | 4446 | 242 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 200 | 1422 | −3783 | −842 | 500 | −3969 | 1010 | −2412 | 604 | −2070 | −3740 | 287 | −2443 | −3822 | 2323 | −2544 | 369 | −2631 | −528 | −4055 | −349 | 243 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 201 | 245 | −4046 | 1571 | 712 | −4332 | 1829 | 1426 | −221 | −757 | −1825 | −3145 | −565 | −3740 | −1862 | −2407 | −2557 | 129 | 557 | −4251 | −3590 | 244 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 202 | −3291 | −3098 | −5626 | −4998 | 3170 | 1630 | −3670 | −1028 | −4599 | 598 | 1719 | −4488 | −4864 | −4181 | −4386 | −3940 | 853 | −2447 | −3453 | −239 | 245 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10521 | −11563 | −894 | −1115 | −701 | −1378 | * | * | | | | | | | | | | | | |
| 203 | 1330 | 1393 | −5216 | 194 | −562 | 533 | −3321 | −2233 | −4186 | −807 | 741 | −4086 | −4502 | −3816 | −3999 | −562 | −1199 | 2383 | −3198 | −193 | 246 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10521 | −11563 | −894 | −1115 | −701 | −1378 | * | * | | | | | | | | | | | | |
| 204 | −129 | −3103 | −1248 | −1069 | 2217 | −656 | 195 | −929 | −2898 | −706 | 209 | −1142 | 10 | −2764 | 226 | 701 | −884 | −1020 | 1119 | 2237 | 247 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −42 | −10521 | −5148 | −894 | −1115 | −701 | −1378 | * | * | | | | | | | | | | | | |
| 205 | −345 | −4183 | 198 | 679 | −4502 | 2887 | −2327 | −4256 | −260 | −4199 | −3275 | 208 | −1072 | −280 | −2433 | −658 | −814 | −3805 | −4366 | −3678 | 248 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −584 | −10480 | −1591 | −894 | −1115 | −1531 | −613 | * | * | | | | | | | | | | | | |
| 206 | 672 | −3625 | 1707 | 811 | −3945 | 736 | 27 | −3696 | −1364 | −3640 | −2715 | −93 | −405 | 288 | −1873 | 1507 | −24 | −3246 | −3808 | −3123 | 249 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −61 | −9898 | −4627 | −894 | −1115 | −1712 | −525 | * | * | | | | | | | | | | | | |
| 207 | −168 | 1738 | −442 | −1947 | 249 | −696 | −2108 | −2894 | 817 | 1105 | 1230 | −2191 | 1444 | 194 | −2280 | 501 | −604 | −2663 | −3472 | −2941 | 250 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1358 | −10046 | −716 | −894 | −1115 | −3843 | −104 | * | * | | | | | | | | | | | | |
| 208 | −117 | −3397 | 2295 | 1976 | −3684 | −2521 | −1406 | −3460 | −1145 | −363 | −2525 | 614 | 1395 | −983 | −1713 | −1689 | −1826 | −3006 | −3585 | −2840 | 251 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −5 | −8693 | −9735 | −894 | −1115 | −5096 | −43 | * | * | | | | | | | | | | | | |
| 209 | 840 | −2870 | −1296 | 2103 | −3223 | −2386 | 1908 | −2947 | 1671 | −2869 | −1962 | −1022 | −2472 | 960 | 488 | −1319 | −1367 | −2511 | −3007 | −2373 | 252 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −5 | −8693 | −9735 | −894 | −1115 | −846 | −1173 | * | * | | | | | | | | | | | | |
| 210 | −674 | −3632 | 2606 | −355 | −3946 | −651 | −1812 | −524 | 163 | −461 | 498 | −1791 | −417 | −421 | 207 | 578 | −975 | −3250 | −3820 | 102 | 253 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −297 | −9963 | −2435 | −894 | −1115 | −4016 | −92 | * | * | | | | | | | | | | | | |
| 211 | 2296 | −2945 | −5113 | −4640 | 2846 | −4516 | 832 | −2514 | −4269 | −2751 | −2194 | −3983 | 1424 | −3806 | −4078 | −3630 | −3089 | −525 | −2262 | 724 | 254 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −142 | −9668 | −3433 | −894 | −1115 | −4450 | −68 | * | * | | | | | | | | | | | | |
| 212 | 556 | −2242 | −2801 | 941 | 115 | −3255 | −2017 | 488 | −486 | −2118 | −1424 | 97 | −3326 | 479 | −2355 | −2248 | −4 | 1268 | 2870 | 1723 | 255 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −3 | −9529 | −10571 | −894 | −1115 | −1243 | −792 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 213 | 1453 | −3690 | −2072 | 294 | −4008 | 69 | −1857 | −3757 | −1438 | −1453 | −2780 | −163 | 1320 | 106 | −230 | 1532 | 596 | −3311 | −3875 | −3194 | 256 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −309 | −10018 | −2382 | −894 | −1115 | −2852 | −215 | * | * | | | | | | | | | | | | |
| 214 | −369 | −2746 | −327 | −1917 | −2819 | −777 | 474 | 1461 | −1796 | 390 | −1907 | 748 | −3347 | 165 | 313 | −2220 | 1064 | 1356 | −3100 | −2612 | 257 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −575 | −9770 | −1609 | −894 | −1115 | −4323 | −74 | * | * | | | | | | | | | | | | |
| 215 | 1219 | −1816 | −3679 | −3089 | 588 | 2773 | −2217 | −1350 | −2739 | −647 | 817 | −2800 | −3387 | −2502 | 74 | −2366 | −1819 | −1265 | −2290 | −1926 | 258 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | −9199 | −10241 | −894 | −1115 | −4850 | −51 | * | * | | | | | | | | | | | | |
| 216 | 340 | 1442 | −1533 | 1691 | −3133 | −595 | −1275 | −2832 | −884 | 92 | −1994 | −1278 | −2699 | 220 | 2269 | −1523 | 178 | −2467 | −3113 | −2480 | 259 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −488 | −9199 | −1809 | −894 | −1115 | −4850 | −51 | * | * | | | | | | | | | | | | |
| 217 | −1792 | −2401 | −4580 | −4891 | −4961 | 3507 | −4265 | −4718 | −4829 | −5039 | −4116 | −3398 | −3478 | −4326 | −4561 | 469 | −2264 | −230 | −5200 | −5101 | 260 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −134 | −8716 | −3536 | −894 | −1115 | −5088 | −43 | * | * | | | | | | | | | | | | |
| 218 | −1841 | −1607 | −4203 | −3618 | −1693 | −3518 | −2494 | 2021 | −3267 | 1021 | −832 | −3162 | −3539 | −2928 | −3118 | 1080 | 600 | 1819 | −2342 | −1989 | 261 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −6 | −8587 | −9629 | −894 | −1115 | −5134 | −42 | * | * | | | | | | | | | | | | |
| 219 | 2480 | 3297 | −3710 | −3318 | −2547 | −2591 | 1869 | −2109 | −3050 | −2452 | −1754 | −2711 | −3104 | −2778 | −3062 | 615 | −1723 | 573 | −2978 | −2646 | 262 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −6 | −8587 | −9629 | −894 | −1115 | −5134 | −42 | * | * | | | | | | | | | | | | |
| 220 | −2042 | −3514 | 944 | 3034 | −3384 | −260 | −1531 | −3521 | −1386 | −3486 | −2672 | −1210 | −2885 | −1164 | −1974 | −1862 | −2022 | −3111 | 2572 | 1292 | 263 |
| — | −147 | −502 | 235 | 43 | −382 | 397 | 108 | −625 | 208 | −465 | −722 | 275 | 394 | 46 | 94 | 360 | 119 | −371 | −296 | −243 | |
| H | −111 | −3784 | −9629 | −3929 | −98 | −26 | −5811 | * | * | | | | | | | | | | | | |
| 221 | 3 | 446 | −4713 | −1335 | −2773 | −4371 | 268 | 1342 | −1512 | 371 | −2008 | −3834 | −441 | −487 | 2394 | −3430 | −2828 | 834 | 1144 | 551 | 282 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 222 | 1303 | 478 | 81 | −1626 | 867 | −703 | 705 | −190 | −3734 | 616 | −346 | −3782 | 833 | −685 | −3745 | 453 | −1043 | 214 | −3271 | −654 | 283 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10521 | −11563 | −894 | −1115 | −701 | −1378 | * | * | | | | | | | | | | | | |
| 223 | −2654 | −4091 | 213 | −191 | 1963 | 748 | −2293 | −1401 | 56 | 833 | −3184 | 1419 | −3726 | −398 | −970 | −972 | 663 | −3705 | 818 | −3610 | 284 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10521 | −11563 | −894 | −1115 | −701 | −1378 | * | * | | | | | | | | | | | | |
| 224 | 327 | −2754 | −1051 | −52 | −524 | −2055 | −3347 | 254 | −4221 | 1816 | 382 | −4115 | −4524 | −3847 | −4028 | −3559 | −2867 | 2236 | −3216 | −2874 | 285 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10521 | −11563 | −894 | −1115 | −701 | −1378 | * | * | | | | | | | | | | | | |
| 225 | 1072 | −4123 | 895 | 1348 | −4444 | −350 | −2283 | −1259 | 699 | −4139 | 1738 | 102 | −3717 | −48 | −1173 | 1091 | −1003 | −2011 | −4306 | −3624 | 286 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 226 | 203 | −4124 | 1345 | 1449 | −4445 | 445 | −36 | −4195 | 707 | −4140 | −422 | −379 | 1209 | −592 | 535 | −1507 | 142 | −1535 | −4307 | −3624 | 287 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −41 | −10521 | −5202 | −894 | −1115 | −701 | −1378 | * | * | | | | | | | | | | | | |
| 227 | −386 | −550 | 545 | 986 | −4337 | 1336 | 1433 | −1932 | −71 | −1978 | −831 | −2248 | −3696 | −1812 | 747 | −596 | −864 | −1486 | −4236 | 2404 | 288 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −37 | −10481 | −5344 | −894 | −1115 | −1507 | −625 | * | * | | | | | | | | | | | | |
| 228 | −1015 | −2968 | 1470 | −1594 | −895 | −1164 | −197 | 1244 | −575 | −129 | −99 | −3202 | 1970 | −2830 | −3232 | −703 | −339 | 1030 | −3383 | −2978 | 289 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −20 | −10446 | −6293 | −894 | −1115 | −820 | −1205 | * | * | | | | | | | | | | | | |
| 229 | −322 | −4077 | 1250 | 1386 | −4398 | −1231 | 1577 | −4149 | −146 | −4093 | −3167 | 2217 | 440 | −1778 | −2325 | −491 | −1122 | −1241 | 1969 | −79 | 290 |
| — | −149 | −482 | 232 | 44 | −381 | 398 | 105 | −627 | 210 | −467 | −721 | 275 | 393 | 45 | 95 | 360 | 117 | −367 | −282 | −250 | |
| T | −5633 | −3231 | −195 | −318 | −2336 | −1075 | −929 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 230 | −1642 | −3350 | 1246 | 1147 | −3592 | −1915 | −1042 | −3428 | 802 | −3330 | −2532 | 3284 | −2319 | −662 | −1649 | −1388 | −1651 | −2943 | −3509 | −2651 | 293 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −11 | −7624 | −8666 | −894 | −1115 | −4175 | −82 | * | * | | | | | | | | | | | | |
| 231 | −1262 | −2460 | −1252 | −620 | −2828 | 1681 | −673 | −2466 | 1826 | −2418 | −1582 | −850 | −2246 | 1148 | 919 | −1172 | −1163 | 955 | −2556 | −2046 | 294 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1386 | −7896 | −706 | −894 | −1115 | −3591 | −125 | * | * | | | | | | | | | | | | |
| 232 | −1632 | −2633 | −1862 | −962 | −3200 | −2392 | −562 | −2717 | 2055 | −2511 | −1751 | −1051 | −2388 | 2350 | 2097 | −1521 | −1437 | −2415 | 2869 | −2175 | 295 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −13 | −7382 | −8424 | −894 | −1115 | −2216 | −350 | * | * | | | | | | | | | | | | |
| 233 | 123 | −2828 | 2416 | 900 | −3145 | 235 | −965 | −2899 | 343 | −2842 | −1920 | 274 | −2391 | 1164 | −1079 | −1218 | 576 | −2448 | −3010 | −2320 | 296 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −5 | −8735 | −9777 | −894 | −1115 | −3923 | −98 | * | * | | | | | | | | | | | | |
| 234 | −1531 | −1427 | −3468 | −2855 | 859 | −3030 | −1875 | 732 | −2516 | 1599 | −611 | 714 | −3082 | 603 | 1715 | −2097 | −1471 | 597 | −1875 | −1524 | 297 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −5 | −8864 | −9906 | −894 | −1115 | −453 | −1891 | * | * | | | | | | | | | | | | |
| 235 | −413 | 111 | 136 | −4348 | −605 | −1098 | −3070 | 981 | −3947 | 1794 | −1685 | −3841 | −4250 | −3573 | −771 | −3284 | 833 | 1599 | −2940 | −2598 | 298 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10234 | −11276 | −894 | −1115 | −95 | −3968 | * | * | | | | | | | | | | | | |
| 236 | 727 | 118 | −5264 | −4628 | 986 | −1850 | 2131 | 1784 | −4223 | 1452 | 300 | −4113 | −4516 | −3846 | −4023 | −3551 | −2859 | 1091 | −3203 | −2861 | 299 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 237 | −1203 | 137 | −5270 | −1270 | −2709 | −4477 | −3350 | 2220 | −4232 | 628 | −1956 | −4122 | −4526 | −3856 | −4033 | −1355 | 1194 | 2154 | −3215 | −269 | 300 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 238 | 637 | 2257 | −5256 | −1719 | −367 | −4459 | −3330 | −830 | −4215 | 1097 | 962 | −4105 | −4509 | −3838 | −4015 | 182 | 576 | 2093 | −3196 | −2854 | 301 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 239 | −2734 | −4069 | −2639 | −2093 | −4371 | 1746 | −2392 | −4086 | −1972 | −4088 | −3198 | 1164 | −3818 | 2282 | 1247 | −42 | −48 | −576 | −4300 | 1762 | 302 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 240 | −3542 | −4154 | −6751 | −7107 | −6886 | 977 | −6190 | −6718 | −6861 | −6976 | −5999 | −5251 | −5248 | −6283 | −6480 | 2673 | 2755 | −5378 | −7099 | −7087 | 303 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 241 | −1169 | 1205 | −5259 | −4623 | 2884 | −1213 | −3332 | −2229 | −4218 | 1631 | 1671 | −4107 | −4511 | −3841 | −4018 | −3546 | −935 | 76 | −3197 | 1548 | 304 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 242 | 1145 | −4136 | −6889 | −7241 | −6877 | 1417 | −6207 | −6705 | −6891 | −6966 | −5985 | −5262 | −5237 | −6309 | −6485 | 3082 | −1018 | −5361 | −7098 | −7091 | 305 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 243 | −5679 | −6012 | −6638 | −6016 | −7635 | −6027 | −5171 | −7416 | 4009 | −7100 | −6492 | −5723 | −6410 | −4866 | −3903 | −5788 | −1028 | −6876 | −6601 | −6815 | 306 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 244 | 1939 | −4015 | 941 | −2055 | −616 | −1388 | −2364 | −1377 | −1970 | −4033 | −3144 | 2033 | −3781 | −1924 | −746 | 1448 | −98 | −3628 | −4257 | −3609 | 307 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10521 | −11563 | −894 | −1115 | −701 | −1378 | * | * | | | | | | | | | | | | |
| 245 | −4245 | −3969 | −6293 | −5848 | 3287 | −5643 | 37 | −1042 | −5438 | 1104 | 2640 | −5049 | −5645 | −4877 | −232 | −4757 | −4176 | −3435 | 990 | 1774 | 308 |
| — | −149 | −500 | 233 | 43 | −381 | 400 | 106 | −626 | 210 | −466 | −720 | 275 | 394 | 45 | 96 | 359 | 117 | −369 | −294 | −249 | |
| T | −36 | −5370 | −11563 | −163 | −3229 | −701 | −1378 | * | * | | | | | | | | | | | | |
| 246 | 882 | −4115 | −6568 | −6801 | −6568 | 3244 | −5991 | −6322 | −6590 | −1898 | −5696 | 302 | −5216 | −6074 | −6301 | 381 | −3983 | −1335 | −6831 | −6736 | 310 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 247 | 888 | 172 | −5339 | −4705 | −515 | −4546 | −3420 | −565 | −4302 | 2265 | 2333 | −4193 | −4590 | −3921 | −4102 | 31 | −2931 | 573 | −3275 | −2938 | 311 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10521 | −11563 | −894 | −1115 | −701 | −1378 | * | * | | | | | | | | | | | | |
| 248 | 1726 | −3176 | −3496 | −1106 | −3206 | −4053 | −2810 | −2780 | −2786 | −3064 | 843 | −3055 | 1761 | −550 | −3109 | −503 | 1192 | −551 | −3575 | 2631 | 312 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −10521 | −11563 | −894 | −1115 | −701 | −1378 | * | * | | | | | | | | | | | | |
| 249 | 33 | −4321 | −5417 | −5717 | −6915 | 3564 | −5669 | −6738 | −5679 | −6918 | −5999 | 230 | −5283 | −5573 | −334 | −3906 | −4135 | −5484 | −7007 | −6874 | 313 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −373 | −10521 | −2139 | −894 | −1115 | −701 | −1378 | * | * | | | | | | | | | | | | |
| 250 | −2804 | −2708 | −1051 | 1748 | 1672 | −4277 | −3062 | 642 | −3743 | 1276 | −1796 | −3729 | −4324 | −745 | −3709 | −3353 | −2744 | −2101 | 4107 | −2588 | 314 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −2 | −10150 | −11192 | −894 | −1115 | −3574 | −127 | * | * | | | | | | | | | | | | |
| 251 | −5207 | −5528 | −6771 | −6054 | −7239 | −5624 | −5066 | −7153 | −3875 | −6875 | −6263 | −5597 | −6076 | −4801 | 4192 | −5370 | −554 | −6516 | −6330 | −6575 | 315 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −2 | −10150 | −11192 | −894 | −1115 | −3574 | −127 | * | * | | | | | | | | | | | | |
| 252 | −1268 | 875 | −5797 | −5228 | −3232 | −902 | −4128 | 1913 | −4889 | 1212 | 599 | −4771 | −5116 | −4556 | −4740 | −4251 | −3318 | 2626 | −3944 | −3584 | 316 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10150 | −11192 | −894 | −1115 | −78 | −4251 | * | * | | | | | | | | | | | | |
| 253 | 499 | −4823 | −7095 | −7460 | −7401 | 3687 | −6659 | −7382 | −7363 | −7546 | −6667 | −5909 | −5848 | −6848 | −6970 | −4554 | −4769 | −6099 | −7242 | −7556 | 317 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 254 | 1349 | 119 | −5253 | −4617 | 2003 | −1623 | −3328 | 506 | −4212 | −2585 | 141 | −1271 | −4507 | −3836 | −4013 | −861 | −2851 | −906 | 2465 | 3193 | 318 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 255 | 999 | 1164 | −5363 | −4734 | −120 | −384 | −3459 | 2067 | −4334 | 917 | −2035 | −4222 | −4621 | −3961 | −4138 | −3664 | 308 | 1602 | −3321 | −2977 | 319 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 256 | 975 | 581 | −5253 | −4617 | 135 | −1763 | −3328 | 478 | −4212 | 1046 | −1939 | −1271 | −4507 | −3836 | −4013 | 413 | 809 | 719 | −3194 | 2133 | 320 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 257 | 1460 | 1426 | −5255 | −4621 | −2702 | 1674 | −3338 | 592 | −4218 | −1000 | −1950 | −4107 | −4513 | −3842 | −4021 | 800 | −225 | 1292 | −3206 | −271 | 321 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2300 | −10521 | −329 | −894 | −1115 | −701 | −1378 | * | * | | | | | | | | | | | | |
| 258 | 155 | −1009 | −2736 | 780 | 1770 | −2517 | −1342 | 993 | −1865 | 536 | −206 | 397 | −2574 | −1606 | −1894 | −1569 | −996 | −429 | −1442 | 2167 | 322 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −7 | −8228 | −9270 | −894 | −1115 | −24 | −5915 | * | * | | | | | | | | | | | | |
| 259 | −2653 | 133 | 1063 | −1961 | −4411 | −3630 | 1097 | −4154 | −661 | −2173 | −166 | 2147 | 252 | −390 | −100 | 1168 | 347 | 966 | −4290 | −3614 | 323 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 260 | 1291 | 2198 | 1311 | 1211 | −4444 | −3624 | −2283 | −4195 | −85 | −2103 | −3212 | −2260 | 404 | 427 | −110 | 913 | −410 | −3745 | −4307 | −3624 | 324 |
| — | −147 | −501 | 231 | 47 | −382 | 397 | 104 | −628 | 213 | −467 | −722 | 274 | 394 | 47 | 97 | 360 | 117 | −371 | −296 | −251 | |
| H | −5685 | −1906 | −486 | −17 | −6389 | −701 | −1378 | * | * | | | | | | | | | | | | |
| 261 | −1327 | −2808 | 1923 | 426 | −3125 | −2262 | 1644 | −2879 | −545 | −2822 | −1901 | 1331 | −2374 | −493 | 689 | 1396 | 455 | −2428 | −2991 | −2301 | 326 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −5 | −8717 | −9759 | −894 | −1115 | −5087 | −43 | * | * | | | | | | | | | | | | |
| 262 | 2253 | −2874 | 701 | 225 | −3282 | 140 | −1144 | −3033 | −777 | −2995 | −2087 | −1041 | 998 | −701 | −1295 | −3 | 338 | −2574 | −3176 | −2491 | 327 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −134 | −8717 | −3538 | −894 | −1115 | −3873 | −102 | * | * | | | | | | | | | | | | |
| 263 | 40 | −2816 | 1732 | 2054 | −3131 | −2277 | −963 | 192 | 460 | −2830 | −1909 | 790 | −2389 | −508 | −1074 | 471 | −1282 | −2435 | −3000 | −2312 | 328 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −5 | −8741 | −9783 | −894 | −1115 | −4004 | −93 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 264 | 608 | −2611 | −1282 | 276 | 538 | −2355 | −1023 | −267 | 471 | −2593 | −1722 | 1477 | −2446 | 695 | −1132 | 1296 | 96 | 225 | −2845 | −2214 | 329 |
| — | −150 | −501 | 231 | 42 | −378 | 399 | 104 | −628 | 213 | −463 | −722 | 279 | 394 | 50 | 94 | 359 | 116 | −371 | −296 | −251 | |
| H | −114 | −3744 | −9899 | −3400 | −144 | −5030 | −45 | * | * | | | | | | | | | | | | |
| 265 | 2073 | −1773 | −2196 | −1630 | −1796 | 847 | −1467 | 146 | −1470 | −293 | −956 | −1735 | −2784 | 773 | 676 | −396 | −1382 | 53 | −2175 | −1748 | 342 |
| — | −150 | −501 | 238 | 41 | −382 | 398 | 104 | −628 | 211 | −466 | −722 | 276 | 394 | 47 | 94 | 360 | 119 | −369 | −296 | −251 | |
| H | −4021 | −93 | −9899 | −16 | −6535 | −28 | −5707 | * | * | | | | | | | | | | | | |
| 266 | 1458 | −4119 | 335 | 1523 | −4438 | −3625 | −91 | −362 | −208 | −4134 | −609 | 186 | −60 | −1825 | 1354 | −679 | −344 | −702 | 848 | −3622 | 344 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 267 | −170 | −2747 | −5268 | −4632 | −522 | −4470 | −3342 | 1513 | −4227 | 1173 | 384 | −4116 | −4519 | −3849 | −4027 | −1730 | −2862 | 2576 | 953 | −53 | 345 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 268 | 315 | 1362 | −1234 | −499 | −913 | −4398 | −3248 | 1937 | 407 | 803 | −1988 | −3913 | −4452 | −3615 | 696 | −3465 | −2836 | 1530 | −3239 | −2887 | 346 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 269 | −110 | −4124 | 1652 | 639 | −4445 | −1514 | −499 | −4196 | −272 | −1685 | −3213 | 1195 | −3717 | 465 | 281 | 1852 | −394 | −3746 | −4307 | −3624 | 347 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 270 | 1416 | 1971 | −3089 | −2533 | −1035 | −20 | 1611 | −331 | −855 | −1588 | −2571 | −876 | −3980 | 2353 | −325 | −1055 | −621 | −2898 | 800 | 1094 | 348 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 271 | 777 | −2932 | −5463 | −4828 | −374 | −4675 | −3543 | 254 | −4427 | 2239 | 2519 | −4322 | −4705 | −557 | −4221 | −3763 | −3055 | 714 | −3374 | −247 | 349 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 272 | 815 | −4100 | −1042 | −231 | −4410 | −1347 | −2290 | −357 | 1557 | −661 | 25 | 637 | −3723 | 274 | 1897 | −2538 | −73 | −514 | −4290 | −538 | 350 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 273 | −225 | −4117 | 450 | −692 | −1064 | −492 | −2285 | 150 | 1649 | −337 | −312 | 660 | −932 | 981 | 959 | 411 | −2590 | −1613 | −4302 | −3621 | 351 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 274 | −67 | −2742 | −1135 | −4574 | 738 | −1303 | −3319 | 1042 | −4179 | 1116 | 2370 | −913 | −4501 | −719 | −17 | −3533 | −244 | 1359 | 1091 | −2855 | 352 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 275 | 1496 | −4054 | −614 | −1987 | −4343 | −635 | 283 | 529 | 648 | −846 | −5 | −533 | −3736 | 732 | 64 | 1240 | −2597 | 133 | −4256 | −3593 | 353 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10521 | −11563 | −894 | −1115 | −701 | −1378 | * | * | | | | | | | | | | | | |
| 276 | 301 | −4122 | −40 | −718 | −4443 | 70 | −2283 | −4193 | −1864 | −1773 | 17 | 216 | −412 | −300 | 2557 | 1118 | 407 | −3744 | −4306 | −3624 | 354 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 277 | −574 | −3751 | −2741 | −2190 | 1233 | 130 | 1588 | −1487 | −2092 | −784 | −2881 | 68 | 2550 | 93 | 473 | −21 | 161 | −3293 | −4030 | −3449 | 355 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −44 | −10521 | −5086 | −894 | −1115 | −701 | −1378 | * | * | | | | | | | | | | | | |
| 278 | −1440 | −2698 | −5212 | −4576 | 2231 | 572 | −3289 | 53 | −4172 | 24 | 2129 | −239 | −4468 | −979 | −3974 | −660 | −1215 | 729 | 1130 | 2117 | 356 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10478 | −11520 | −894 | −1115 | −1559 | −598 | * | * | | | | | | | | | | | | |
| 279 | −338 | 2140 | −5202 | −4567 | −406 | −4417 | 201 | 1420 | −4165 | 768 | −1902 | 1258 | −977 | −3790 | −3970 | −1282 | 150 | −2113 | 1554 | 2605 | 357 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10478 | −11520 | −894 | −1115 | −1559 | −598 | * | * | | | | | | | | | | | | |
| 280 | −1161 | −2700 | −5215 | −4579 | 2270 | −494 | −3292 | −104 | −4175 | −309 | −1903 | −4065 | −4470 | −3799 | −3976 | 2019 | −77 | 1329 | −3158 | 642 | 358 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1059 | −10478 | −945 | −894 | −1115 | −1559 | −598 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 281 | 510 | 1061 | −2322 | −1770 | −2648 | 326 | −1824 | −2248 | −1648 | −2484 | 829 | 2349 | 863 | −1559 | −2043 | 711 | 386 | −2047 | −2931 | 1364 | 359 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −162 | −9422 | −3252 | −894 | −1115 | −4690 | −57 | * | * | | | | | | | | | | | | |
| 282 | −350 | −2898 | −5264 | −5520 | −5380 | −3190 | −4759 | −5143 | −5289 | −5411 | 1392 | −3933 | 3960 | −4828 | −5015 | 14 | −2763 | −4003 | −5637 | −5540 | 360 |
| — | −149 | −500 | 233 | 43 | −381 | 398 | 105 | −623 | 210 | −464 | −721 | 275 | 394 | 45 | 96 | 359 | 117 | −369 | −295 | −250 | |
| . | −166 | −3215 | −10305 | −94 | −3979 | −33 | −5485 | * | * | | | | | | | | | | | | |
| 283 | −825 | 1467 | 359 | −3264 | −651 | −4089 | −3447 | −4500 | −3190 | −4646 | −3815 | −3368 | 2127 | −582 | −3613 | 2574 | 840 | −4053 | −4961 | −4441 | 362 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 284 | 490 | −4072 | −981 | 325 | −4369 | 88 | −2300 | −402 | −1890 | −2163 | −3167 | 93 | −3731 | −1848 | −7 | 1666 | 2161 | −1660 | −4270 | −3601 | 363 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 285 | 509 | 675 | −5050 | −4427 | 219 | −505 | 2509 | −165 | −4065 | 72 | −1962 | −1278 | 1277 | 1515 | −3935 | 292 | −2843 | 604 | −3215 | −348 | 364 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 286 | 856 | −2909 | −5402 | −4812 | −2956 | 1728 | −3561 | −2485 | −4417 | 1269 | 1085 | −4237 | −4612 | −4041 | −4225 | −35 | 1365 | 650 | −3458 | −3119 | 365 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 287 | 1711 | 589 | −5166 | −4739 | −4468 | −1779 | −4302 | −4057 | −4529 | −1576 | −3646 | −4320 | 1623 | 3211 | −4661 | 362 | −3490 | −990 | −4861 | −4510 | 366 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 288 | 1190 | −4093 | −789 | 260 | −1550 | −1351 | 235 | −1338 | −662 | −1145 | −3186 | −2273 | 1667 | 753 | 1188 | −469 | −760 | −1419 | 450 | 1115 | 367 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 289 | 2131 | −2737 | −5250 | −4614 | −79 | −1558 | −3328 | 1423 | −4210 | 266 | 363 | −4101 | −986 | −958 | −4012 | −708 | −307 | 710 | −3194 | 612 | 368 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 290 | 2000 | 618 | −5047 | −4424 | −2718 | −1555 | −3288 | −326 | −4063 | 993 | −1963 | −893 | −4479 | −717 | −1280 | −569 | −223 | 1743 | −3216 | −2869 | 369 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 291 | 1989 | −3104 | −3623 | −1203 | −3117 | −655 | −2856 | 337 | −118 | 343 | −150 | −822 | −4167 | −2761 | −1120 | 81 | −77 | 1243 | −3509 | −3088 | 370 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 292 | 2438 | −4123 | −895 | 573 | −1743 | −655 | −2283 | −4195 | −64 | −4139 | −3212 | 75 | −3717 | 410 | −1015 | −357 | 1110 | −1391 | −4306 | −3624 | 371 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 293 | 2285 | −2740 | −5218 | −4584 | −2695 | −335 | 355 | 1328 | −4187 | −487 | 1693 | −4086 | −4503 | −654 | −4000 | 45 | −1254 | 403 | 875 | −2855 | 372 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 294 | 462 | −2746 | −5266 | −4630 | −518 | −4469 | −3340 | 119 | −4226 | 2550 | 415 | −4115 | −4518 | −3848 | −4025 | −1394 | −138 | 548 | −3205 | −391 | 373 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 295 | −1010 | 392 | 705 | 210 | −4441 | −407 | 182 | 105 | −535 | −1091 | −103 | 1511 | −3718 | 448 | 480 | 1597 | −1209 | −3742 | −4305 | −375 | 374 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 296 | 570 | −4124 | 2819 | −773 | −846 | 616 | 249 | −4196 | 29 | −4140 | −3213 | 360 | −154 | −1824 | −722 | −539 | −291 | −3746 | −4308 | −3625 | 375 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −42 | −10521 | −5148 | −894 | −1115 | −701 | −1378 | * | * | | | | | | | | | | | | |
| 297 | 494 | −4076 | 832 | 929 | 122 | −1352 | −2251 | −1220 | −990 | −4090 | −3167 | −2229 | 1317 | 914 | −516 | 770 | 404 | 25 | −4263 | −153 | 376 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10480 | −11522 | −894 | −1115 | −1531 | −613 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 298 | 239 | −4084 | 1320 | 1032 | −809 | −1309 | 135 | −1 | 39 | 746 | −3174 | −629 | 525 | 1555 | −2336 | −1156 | −1160 | −3705 | −4268 | −3587 | 377 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −190 | −10480 | −3025 | −894 | −1115 | −1531 | −613 | * | * | | | | | | | | | | | | |
| 299 | −1011 | −3798 | 406 | 537 | 1719 | −1156 | −2126 | −173 | 264 | 1206 | 580 | −2121 | −3553 | 1932 | −808 | −939 | −2404 | −3390 | −4016 | −3368 | 378 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −155 | −10291 | −3310 | −894 | −1115 | −3052 | −185 | * | * | | | | | | | | | | | | |
| 300 | −2457 | −2842 | −787 | 54 | 164 | −846 | 145 | 1085 | 1105 | −1062 | 456 | −2693 | −3780 | −2300 | 1168 | −2686 | 334 | 1429 | −3234 | 836 | 379 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −241 | −10138 | −2711 | −894 | −1115 | −3606 | −124 | * | * | | | | | | | | | | | | |
| 301 | 828 | −3556 | 204 | −218 | −3858 | −51 | −1769 | 999 | −392 | −40 | 689 | 658 | −3201 | 1159 | 551 | −212 | −2066 | −79 | −3750 | −3079 | 380 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −61 | −9900 | −4629 | −894 | −1115 | −4128 | −85 | * | * | | | | | | | | | | | | |
| 302 | −853 | −3549 | 1083 | 1138 | −3870 | −1012 | −1708 | −1081 | 694 | −714 | −2638 | 32 | 597 | 1317 | 300 | 1207 | −2015 | −3171 | −3732 | −3049 | 381 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1033 | −9841 | −971 | −894 | −1115 | −4222 | −79 | * | * | | | | | | | | | | | | |
| 303 | −2236 | −2807 | −4512 | −4788 | −4054 | 370 | −4086 | −4982 | −4725 | −5109 | −4325 | −3649 | −3833 | −4387 | −4550 | 1074 | −2689 | −3909 | 5801 | −3796 | 382 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −5 | −8813 | −9855 | −894 | −1115 | −5049 | −44 | * | * | | | | | | | | | | | | |
| 304 | −20 | −2710 | 523 | 1457 | 465 | −2295 | −958 | −2729 | 434 | 580 | −1807 | −943 | −2389 | 865 | −1054 | −1206 | 1582 | −2315 | −2912 | −2248 | 383 |
| — | −149 | −488 | 233 | 43 | −381 | 398 | 105 | −623 | 210 | −466 | −721 | 275 | 396 | 45 | 96 | 359 | 117 | −370 | −295 | −250 | |
| H | −371 | −3574 | −2810 | −1511 | −624 | −5049 | −44 | * | * | | | | | | | | | | | | |
| 305 | 780 | −2627 | −1009 | 1203 | −2943 | 826 | 1326 | 456 | 1293 | −2640 | −1717 | 608 | −2231 | 886 | −884 | −1046 | −1103 | −2246 | −2812 | −2132 | 387 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −6 | −8593 | −9635 | −894 | −1115 | −26 | −5809 | * | * | | | | | | | | | | | | |
| 306 | 264 | 441 | 20 | 1865 | 1590 | −3624 | 1658 | −4193 | −122 | −4138 | −3211 | 10 | −3718 | 427 | −988 | −380 | −864 | −3744 | 1862 | 1141 | 388 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 307 | −2909 | −2739 | −5229 | −476 | 294 | 337 | −248 | −426 | −4195 | 1634 | 1836 | −731 | −4504 | −3823 | −4004 | −1660 | −14 | 1766 | −3196 | −271 | 389 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 308 | −48 | −4123 | 869 | 1757 | −4445 | −1638 | 1007 | −2093 | 1107 | −1773 | −766 | 269 | −286 | 218 | −307 | −113 | 517 | −1215 | −4307 | −3624 | 390 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 309 | 797 | −4123 | −138 | 2054 | −104 | −430 | −2283 | −4194 | 1054 | −4139 | −382 | −558 | −3717 | 1196 | −966 | −1033 | 500 | −1693 | 768 | −3624 | 391 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 310 | −1090 | −3593 | −1181 | −344 | −3719 | −3810 | −2504 | −146 | −2224 | 25 | 3462 | 1196 | −3895 | −2158 | 1346 | 585 | −202 | −3107 | −3906 | 482 | 392 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 311 | 1042 | −3641 | −2846 | −2293 | −3780 | −3795 | −2484 | −1198 | 146 | −861 | −2781 | −593 | −1024 | −854 | 2659 | −440 | −1159 | 1466 | −3944 | −3394 | 393 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 312 | 634 | −4123 | 1315 | 1244 | −4444 | −1698 | −2283 | −360 | 1030 | −2025 | −875 | −2260 | −3717 | 1933 | 525 | 11 | −236 | −3745 | −4306 | −3624 | 394 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 313 | 227 | −4052 | −2537 | −709 | −805 | −397 | 179 | 110 | 705 | −1117 | −3150 | −2293 | −3737 | 903 | 2768 | −507 | −788 | −3657 | −4255 | −184 | 395 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 314 | −1205 | −2761 | −5281 | −4645 | 1019 | −4485 | 714 | 2553 | −4241 | 1795 | 53 | −4130 | −4532 | −1050 | −4040 | −3570 | −2876 | −217 | −3216 | 691 | 396 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 315 | 332 | −3974 | −2583 | 284 | −1522 | −1339 | 130 | 1310 | 1641 | 181 | −84 | −685 | −3759 | 1939 | −299 | −2581 | −1082 | −3560 | 767 | −3556 | 397 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 316 | 575 | −4123 | −59 | 1134 | −778 | −317 | 136 | −1987 | 1094 | −2130 | −3213 | −25 | −3717 | 1555 | 455 | 445 | 125 | −3745 | 857 | −3624 | 398 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 317 | −2657 | −4074 | −2526 | 316 | −4372 | −3639 | 1386 | −4106 | −615 | 184 | 2373 | 1396 | −3732 | −408 | 2214 | 57 | −990 | −682 | −4271 | −371 | 399 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 318 | 846 | −2929 | −4142 | −3561 | −501 | −4246 | 1724 | −55 | −1217 | −649 | −2121 | −3497 | −4309 | −1174 | 2985 | 72 | −1212 | −1159 | −3360 | 226 | 400 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 319 | −136 | −4123 | 1683 | 457 | −4444 | −3624 | −189 | −1466 | 948 | −4139 | 866 | −806 | −3717 | 1775 | 1378 | −1365 | 880 | −1443 | −4307 | −3624 | 401 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 320 | −1458 | −3381 | −3130 | 362 | 789 | −537 | 966 | −934 | −659 | 27 | −459 | −2775 | −3996 | 1034 | 970 | −476 | 178 | 511 | −3737 | 2110 | 402 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 321 | −1461 | 509 | −6861 | −6252 | 2466 | −6213 | −5074 | 28 | −5908 | 2527 | 1086 | −5873 | −6007 | −5305 | −5643 | −5355 | −4402 | −71 | −4536 | −4388 | 403 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 322 | 13 | 390 | −966 | −4188 | −45 | −4386 | 267 | −762 | 98 | −1429 | −1995 | −3879 | −4441 | −3577 | 1962 | −3450 | 1328 | 1479 | −3245 | 1899 | 404 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 323 | 1001 | −4124 | 1595 | 1028 | −4445 | −338 | −2283 | −4195 | 824 | −966 | −3213 | 680 | −1098 | 653 | −1347 | 347 | −420 | −1561 | −4307 | −3624 | 405 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 324 | 924 | −4107 | −2506 | 1170 | −4420 | 1120 | 1644 | −298 | 458 | −288 | −310 | −37 | −3722 | −336 | −181 | 203 | −1224 | −1482 | −4295 | −3616 | 406 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −38 | −10521 | −5290 | −894 | −1115 | −701 | −1378 | * | * | | | | | | | | | | | | |
| 325 | −5848 | 1551 | −8236 | −7640 | 872 | −7959 | −6633 | −350 | −7422 | 2934 | 1279 | −7672 | −7069 | −6236 | −6924 | −7289 | −5695 | −314 | −5248 | −5446 | 407 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −382 | −10484 | −2109 | −894 | −1115 | −1470 | −646 | * | * | | | | | | | | | | | | |
| 326 | 446 | −3766 | 1021 | 1036 | −4087 | −189 | −1925 | −3838 | 489 | −3782 | −2855 | 939 | −3360 | 1458 | 627 | −107 | 625 | −355 | −3949 | −3267 | 408 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10104 | −11146 | −894 | −1115 | −528 | −1706 | * | * | | | | | | | | | | | | |
| 327 | 1427 | −4027 | 353 | 1514 | −4348 | −1097 | 278 | −4099 | 1607 | −4043 | −3116 | −553 | −3621 | 188 | 359 | 56 | −906 | −2008 | 819 | −3527 | 409 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −39 | −10410 | −5263 | −894 | −1115 | −2317 | −323 | * | * | | | | | | | | | | | | |
| 328 | 1262 | 604 | −724 | 125 | −3126 | −3881 | −2619 | 1666 | 56 | 843 | −409 | −2836 | −123 | −2439 | −225 | −1129 | −205 | −143 | −3474 | −3027 | 410 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −860 | −10372 | −1158 | −894 | −1115 | −2600 | −260 | * | * | | | | | | | | | | | | |
| 329 | −1824 | −3212 | 1186 | 901 | 269 | −2811 | 820 | −374 | 1402 | 182 | −2310 | −1460 | 1252 | −1025 | 851 | −1720 | −1763 | −2816 | −3416 | −15 | 411 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −558 | −9515 | −1647 | −894 | −1115 | −4608 | −60 | * | * | | | | | | | | | | | | |
| 330 | −1529 | 1792 | −2385 | −1817 | −1817 | 2213 | −1590 | −1385 | 713 | −1684 | 1306 | −1892 | 523 | −1511 | −1922 | 153 | −1471 | −1255 | 1915 | 844 | 412 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −359 | −8962 | −2196 | −894 | −1115 | −4982 | −46 | * | * | | | | | | | | | | | | |
| 331 | 714 | −1238 | −3224 | −2621 | −1212 | −2804 | −1678 | −749 | −2309 | 883 | 1704 | −2311 | 378 | −2015 | −2268 | 1178 | 1374 | 627 | −1700 | −1346 | 413 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −130 | −8608 | −3581 | −894 | −1115 | −5127 | −42 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 332 | 212 | -2612 | 693 | 1233 | -2931 | -120 | -762 | -2683 | -353 | -2627 | -1704 | 686 | 1855 | -305 | 954 | 183 | -1076 | -2233 | -2796 | -2109 | 414 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -142 | -8484 | -3458 | -894 | -1115 | -4230 | -79 | * | * | | | | | | | | | | | | |
| 333 | -1108 | -2570 | -959 | 668 | -2893 | 999 | 1407 | -2639 | 678 | -603 | -1660 | -715 | -2171 | 1707 | 1337 | 575 | -1045 | -2193 | -2749 | -2074 | 415 |
| — | -149 | -500 | 233 | 43 | -381 | 399 | 106 | -626 | 210 | -466 | -720 | 275 | 394 | 45 | 96 | 359 | 117 | -369 | -294 | -249 | |
| S | -6 | -8474 | -9516 | -894 | -1115 | -25 | -5847 | * | * | | | | | | | | | | | | |
| 334 | -2743 | -4214 | 1845 | -611 | -4529 | 2795 | -2370 | -4280 | -1966 | -4228 | -3308 | -72 | -1013 | -1914 | -103 | -682 | -1222 | -1318 | -4400 | -277 | 416 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -1 | -10521 | -11563 | -894 | -1115 | -701 | -1378 | * | * | | | | | | | | | | | | |
| 335 | -1199 | -2738 | -5244 | -1350 | 2445 | -4456 | -3327 | 1468 | -1365 | 1440 | -1940 | -4098 | -4506 | -828 | -4010 | -3540 | -959 | -86 | 3195 | -230 | 417 |
| — | -149 | -500 | 233 | 43 | -381 | 399 | 106 | -626 | 210 | -466 | -720 | 275 | 394 | 45 | 96 | 359 | 117 | -369 | -294 | -249 | |
| C | -1 | -10521 | -11563 | -894 | -1115 | -701 | -1378 | * | * | | | | | | | | | | | | |
| 336 | 158 | -4123 | 263 | 197 | -4444 | -509 | -2283 | 245 | 919 | -4139 | -3212 | 954 | 989 | 776 | -722 | 732 | 116 | -520 | -4307 | -558 | 418 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -10521 | -11563 | -894 | -1115 | -701 | -1378 | * | * | | | | | | | | | | | | |
| 337 | -708 | 3195 | -5243 | -1395 | 397 | -4456 | 2303 | -95 | -4205 | -679 | 1118 | -952 | -88 | -3830 | -856 | -3540 | -899 | 1792 | 1151 | 558 | 419 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -10521 | -11563 | -894 | -1115 | -701 | -1378 | * | * | | | | | | | | | | | | |
| 338 | -516 | -2755 | -5093 | -1255 | 270 | -677 | -3297 | 1471 | -1258 | 1022 | 909 | -4028 | -1357 | -453 | -1340 | -1342 | 1076 | 740 | 951 | 643 | 420 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -1 | -10521 | -11563 | -894 | -1115 | -701 | -1378 | * | * | | | | | | | | | | | | |
| 339 | -61 | -4119 | 912 | 531 | -4438 | 906 | -2284 | 785 | 600 | -1249 | 17 | -1113 | 1432 | -218 | -722 | -995 | 247 | -1614 | -4303 | -3622 | 421 |
| — | -149 | -500 | 233 | 43 | -381 | 399 | 106 | -626 | 210 | -466 | -720 | 275 | 394 | 45 | 96 | 359 | 117 | -369 | -294 | -249 | |
| C | -30 | -10521 | -5641 | -894 | -1115 | -701 | -1378 | * | * | | | | | | | | | | | | |
| 340 | -564 | -4098 | -299 | -403 | -4418 | -105 | -2258 | -4169 | 574 | -1910 | -3187 | 658 | 1979 | 397 | -2346 | 1950 | -2565 | -1261 | -4281 | -533 | 422 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -79 | -10492 | -4241 | -894 | -1115 | -1333 | -730 | * | * | | | | | | | | | | | | |
| 341 | -1062 | 444 | 860 | 1198 | -4353 | -3532 | -311 | -4104 | 484 | -4048 | -3121 | 1538 | 367 | 2876 | -629 | -1003 | -2498 | -3654 | -4215 | -3532 | 423 |
| — | -149 | -500 | 235 | 43 | -381 | 398 | 105 | -626 | 210 | -466 | -721 | 275 | 394 | 45 | 96 | 359 | 117 | -366 | -295 | -250 | |
| S | -85 | -4136 | -11456 | -82 | -4183 | -199 | -2957 | * | * | | | | | | | | | | | | |
| 342 | 1434 | -4053 | -2553 | -919 | -4346 | 1470 | 1011 | 653 | -1921 | -4062 | -3160 | -204 | -3752 | -1878 | -172 | 1272 | 1051 | -3662 | -4266 | -3606 | 425 |
| — | -149 | -500 | 233 | 43 | -381 | 399 | 106 | -626 | 210 | -466 | -720 | 275 | 394 | 45 | 96 | 359 | 117 | -369 | -294 | -249 | |
| S | -1 | -10521 | -11563 | -894 | -1115 | -701 | -1378 | * | * | | | | | | | | | | | | |
| 343 | 1716 | 528 | -6159 | -6171 | -6581 | 2297 | 1324 | -6366 | -6024 | -6599 | -5665 | 2048 | 3 | -5654 | -5968 | -3743 | 545 | -5219 | -6786 | -6630 | 426 |
| — | -149 | -500 | 233 | 43 | -381 | 399 | 106 | -626 | 210 | -466 | -720 | 275 | 394 | 45 | 96 | 359 | 117 | -369 | -294 | -249 | |
| S | -1 | -10521 | -11563 | -894 | -1115 | -701 | -1378 | * | * | | | | | | | | | | | | |
| 344 | -5173 | -4752 | -7542 | -6949 | 2714 | -7026 | -5753 | 1424 | -6650 | 430 | 3469 | -6685 | -6578 | -5819 | -6301 | -6224 | -5066 | 668 | -4881 | 1281 | 427 |
| — | -149 | -500 | 233 | 43 | -381 | 399 | 106 | -626 | 210 | -466 | -720 | 275 | 394 | 45 | 96 | 359 | 117 | -369 | -294 | -249 | |
| S | -1 | -10521 | -11563 | -894 | -1115 | -701 | -1378 | * | * | | | | | | | | | | | | |
| 345 | -4194 | -3909 | -6463 | -5921 | 3113 | -5800 | -4242 | 1088 | -5550 | -76 | -2551 | -5354 | -5725 | -762 | -5306 | -4925 | -4126 | 1769 | -3768 | 2376 | 428 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -10521 | -11563 | -894 | -1115 | -701 | -1378 | * | * | | | | | | | | | | | | |
| 346 | -648 | 2280 | -5230 | -4596 | -625 | -4454 | 262 | -2231 | -4196 | 1004 | 264 | -4092 | 1511 | -647 | -4005 | 1220 | -183 | 1104 | -3196 | 502 | 429 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -10521 | -11563 | -894 | -1115 | -701 | -1378 | * | * | | | | | | | | | | | | |
| 347 | -1234 | -2760 | -5281 | -4645 | 1951 | -4484 | -3355 | 385 | -4240 | 1036 | 1543 | -4130 | -4532 | -3861 | -4040 | -3569 | -1038 | 1049 | 3559 | 2057 | 430 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -30 | -10521 | -5641 | -894 | -1115 | -701 | -1378 | * | * | | | | | | | | | | | | |
| 348 | -1101 | -3686 | -797 | -797 | -3848 | -1304 | 104 | 264 | -2097 | -43 | 2212 | -2465 | 332 | 418 | 445 | 421 | 1282 | 936 | -3973 | -3403 | 431 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -10492 | -11534 | -894 | -1115 | -412 | -2010 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 349 | −2697 | −3732 | 1671 | −46 | 190 | 1523 | 948 | −351 | −2107 | 309 | −2864 | −611 | −1215 | −2050 | 801 | −1375 | −2637 | 635 | −4015 | −3439 | 432 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 350 | −2910 | 1110 | −5250 | −4614 | 850 | 1282 | 297 | 483 | −298 | 1719 | 482 | −1011 | −216 | −3834 | −4012 | −3541 | −818 | −199 | 622 | −237 | 433 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 351 | 226 | 430 | 1788 | −112 | −4445 | −596 | −2283 | −4196 | −219 | −4140 | −3213 | 675 | 600 | −1823 | 1410 | 1275 | −64 | −3746 | −4307 | −3625 | 434 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −42 | −10521 | −5148 | −894 | −1115 | −701 | −1378 | * | * | | | | | | | | | | | | |
| 352 | 987 | −4088 | −720 | 90 | −4409 | 121 | 1297 | −4159 | 651 | −1776 | 52 | 739 | 2059 | −795 | 254 | −120 | −2554 | −1391 | −4271 | −3588 | 435 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10480 | −11522 | −894 | −1115 | −1531 | −613 | * | * | | | | | | | | | | | | |
| 353 | 716 | −4070 | −862 | 1829 | −4383 | −3593 | 206 | −1186 | 297 | 617 | −3162 | −617 | −1072 | −440 | −2342 | 483 | −44 | 23 | −4258 | −244 | 436 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1775 | −10480 | −500 | −894 | −1115 | −1531 | −613 | * | * | | | | | | | | | | | | |
| 354 | 797 | −1752 | −2024 | 297 | −1781 | −2601 | −1332 | 275 | 596 | 1768 | 1063 | −1581 | −2673 | −1172 | 724 | −1584 | −1298 | −1209 | −2138 | −1703 | 437 |
| — | −151 | −503 | 232 | 42 | −379 | 400 | 102 | −626 | 211 | −469 | −724 | 272 | 398 | 42 | 101 | 357 | 120 | −371 | −298 | −236 | |
| . | −846 | −1176 | −9752 | −2218 | −349 | −3408 | −143 | * | * | | | | | | | | | | | | |
| 355 | −1390 | 1804 | 564 | 151 | −3184 | −210 | 1471 | −2934 | 1894 | −2879 | −1952 | −999 | 365 | 869 | 626 | 591 | −1329 | −2485 | −3046 | −2363 | 445 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −4 | −8938 | −9980 | −894 | −1115 | −4993 | −46 | * | * | | | | | | | | | | | | |
| 356 | −1391 | −2856 | −84 | 1856 | 448 | 429 | −1024 | −2922 | 1413 | −2871 | −1946 | −1001 | −2458 | −565 | −16 | 347 | 368 | −2476 | −3041 | 842 | 446 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −4 | −8938 | −9980 | −894 | −1115 | −4993 | −46 | * | * | | | | | | | | | | | | |
| 357 | 124 | −2863 | 12 | 568 | −3184 | −2363 | −1022 | −2934 | 990 | −2879 | −1952 | 138 | 1432 | 1474 | 1039 | 553 | 266 | −2485 | −3046 | −2363 | 447 |
| — | −151 | −502 | 233 | 44 | −382 | 400 | 104 | −624 | 210 | −465 | −722 | 274 | 392 | 43 | 96 | 361 | 121 | −369 | −296 | −251 | |
| S | −4102 | −88 | −9980 | −15 | −6619 | −2825 | −219 | * | * | | | | | | | | | | | | |
| 358 | −3023 | −2728 | −5382 | −4807 | 3371 | −4741 | −3558 | 1472 | −4463 | 644 | −1251 | 1813 | −4630 | −3971 | −4250 | −3877 | −2958 | −223 | −3139 | −2764 | 449 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | −9237 | −10279 | −894 | −1115 | −4825 | −52 | * | * | | | | | | | | | | | | |
| 359 | 272 | −3135 | 1692 | 2341 | −3444 | −2627 | −1308 | 62 | 761 | −3146 | −2229 | 556 | −2735 | −854 | −1414 | −1559 | −1620 | −388 | −3324 | −2642 | 450 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | −9237 | −10279 | −894 | −1115 | −1496 | −631 | * | * | | | | | | | | | | | | |
| 360 | 871 | −3516 | −4 | −173 | −3834 | −1290 | −1683 | −3582 | 975 | −604 | −2605 | 43 | −3117 | −1224 | 327 | 982 | 1309 | 651 | −3701 | −3020 | 451 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −61 | −9808 | −4624 | −894 | −1115 | −2680 | −245 | * | * | | | | | | | | | | | | |
| 361 | 1880 | 576 | 1621 | 1344 | −3760 | −714 | −1753 | −3484 | −1350 | −3478 | 1603 | −211 | −3181 | −1306 | −1851 | −477 | −358 | −846 | −3685 | −3027 | 452 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −9855 | −10897 | −894 | −1115 | −2066 | −394 | * | * | | | | | | | | | | | | |
| 362 | −834 | −3673 | 365 | 152 | −3985 | −3199 | 1572 | −1548 | 1568 | 416 | 2184 | 54 | −512 | 94 | −1948 | −566 | 20 | −25 | −3862 | −3184 | 453 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10016 | −11059 | −894 | −1115 | −2830 | −219 | * | * | | | | | | | | | | | | |
| 363 | 1544 | −3736 | 683 | 2044 | −4057 | −3237 | −1895 | −3808 | 585 | −3752 | −2825 | −1872 | −3330 | 1575 | −533 | −17 | −2202 | −3358 | 804 | −169 | 454 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10066 | −11108 | −894 | −1115 | −3796 | −108 | * | * | | | | | | | | | | | | |
| 364 | −267 | −2515 | −5043 | −4411 | 2835 | −4264 | −3139 | −581 | −862 | 2234 | −1612 | −3909 | −4297 | −3625 | −3813 | −3353 | −526 | −431 | −2980 | −2650 | 455 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10066 | −11108 | −894 | −1115 | −3796 | −108 | * | * | | | | | | | | | | | | |
| 365 | 1469 | 602 | −4372 | −3765 | 1597 | −3978 | −2823 | −1899 | −3453 | −2247 | −1594 | −3464 | −4033 | 838 | −520 | 1199 | −527 | −667 | 3664 | 862 | 456 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −10066 | −11108 | −894 | −1115 | −66 | −4473 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 366 | −87 | −4123 | 277 | 622 | −4443 | −3624 | −493 | 245 | 1459 | −1935 | −3212 | −2260 | −3718 | 2356 | 1643 | −583 | −989 | −3745 | −4306 | −558 | 457 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 367 | 1090 | −3985 | −834 | −265 | −4245 | −3664 | −2330 | −881 | 1658 | −2521 | 68 | −2326 | −3756 | 770 | −739 | −6 | −2604 | 1925 | −4205 | 394 | 458 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1544 | −10521 | −607 | −894 | −1115 | −701 | −1378 | * | * | | | | | | | | | | | | |
| 368 | 749 | −2868 | 1707 | 1319 | −3177 | −2399 | 1517 | −2920 | −644 | −958 | 1012 | −1039 | −2492 | −603 | 18 | 658 | 368 | −2483 | −3058 | −2382 | 459 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | −8981 | −10023 | −894 | −1115 | −4972 | −47 | * | * | | | | | | | | | | | | |
| 369 | −1522 | −2230 | −1826 | 343 | −2317 | −2654 | −1349 | 717 | −1097 | 249 | −1386 | 261 | −2735 | 945 | 2531 | −1607 | −1459 | −1725 | 2204 | 514 | 460 |
| — | −150 | −503 | 232 | 52 | −374 | 395 | 109 | −621 | 212 | −467 | −724 | 275 | 393 | 46 | 92 | 357 | 116 | −370 | −298 | −247 | |
| H | −123 | −3628 | −10023 | −4287 | −76 | −29 | −5649 | * | * | | | | | | | | | | | | |
| 370 | −1527 | 462 | −7738 | −7191 | −3627 | −7335 | −6262 | 1089 | −6955 | 2936 | 1768 | −7019 | −6808 | −6119 | −6635 | −6591 | −5190 | −1505 | −5250 | −5279 | 483 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 371 | 177 | −2748 | −5163 | −4533 | −2703 | −4445 | −3311 | 1760 | −1647 | 1572 | −1950 | −4061 | −4496 | 821 | 1408 | −3526 | 257 | −41 | 912 | −383 | 484 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 372 | −1182 | −4131 | 1646 | 2309 | −1464 | −3629 | −2289 | −4203 | 371 | −4147 | −3220 | 1734 | −3723 | 917 | −2378 | −1379 | 560 | −3753 | −4314 | −1045 | 485 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 373 | −535 | −4124 | −553 | 2740 | −4445 | −3624 | 290 | −4196 | −139 | −4140 | −121 | −620 | −3717 | 1563 | 1345 | −1340 | −1145 | −3746 | −4307 | −280 | 486 |
| — | −149 | −500 | 233 | 43 | −381 | 398 | 111 | −627 | 210 | −464 | −721 | 275 | 393 | 45 | 96 | 360 | 117 | −370 | −295 | −250 | |
| T | −594 | −3790 | −1914 | −61 | −4593 | −701 | −1378 | * | * | | | | | | | | | | | | |
| 374 | −98 | 1044 | −3007 | 990 | 1158 | −197 | 2389 | −2436 | 550 | −1066 | −1998 | −2589 | −3704 | −111 | −2648 | −1093 | −2336 | 1070 | 823 | 1408 | 488 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10076 | −11118 | −894 | −1115 | −68 | −4448 | * | * | | | | | | | | | | | | |
| 375 | −237 | −4068 | −2529 | −645 | −889 | 2403 | 2359 | −1209 | 1104 | −4073 | −3164 | 702 | −3733 | −1851 | −701 | −560 | −2596 | −588 | −4267 | −3600 | 489 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10521 | −11563 | −894 | −1115 | −701 | −1378 | * | * | | | | | | | | | | | | |
| 376 | −1326 | 475 | −6986 | −6546 | −4455 | −6567 | −5936 | 2316 | −6349 | 131 | −3328 | −6217 | −6440 | −6139 | −6332 | −5799 | −4386 | 2930 | −5615 | 573 | 490 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 377 | 585 | −2741 | −5221 | −4587 | −558 | −4453 | 1147 | 777 | −4189 | −133 | −1943 | 1122 | −4503 | −690 | −1064 | −3536 | −2850 | 923 | 866 | 3209 | 491 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 378 | −238 | 1450 | −5484 | −4862 | −2921 | −4711 | −3607 | 1281 | −4469 | 127 | 1854 | −4358 | −4750 | −4101 | 338 | −3804 | −973 | 2741 | −3464 | −3118 | 492 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 379 | −2889 | −2803 | −1137 | −4142 | 161 | −1471 | −3221 | 747 | −3836 | 382 | 451 | −3853 | −235 | 437 | 1122 | 503 | 1747 | 879 | −3252 | −2896 | 493 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 380 | 867 | 352 | 11 | −1953 | −4433 | −570 | 1417 | −4181 | −333 | −4130 | −3206 | −2263 | 2696 | −297 | 988 | −163 | −760 | −1284 | −4301 | −1099 | 494 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −355 | −10521 | −2199 | −894 | −1115 | −701 | −1378 | * | * | | | | | | | | | | | | |
| 381 | −915 | 898 | −4897 | −4264 | 584 | 2496 | −3004 | 1474 | −3868 | −1073 | −1626 | 992 | −620 | −3498 | −538 | −3218 | −2532 | −487 | 1097 | −2538 | 495 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −2 | −10167 | −11209 | −894 | −1115 | −3522 | −131 | * | * | | | | | | | | | | | | |
| 382 | −850 | −3815 | −2196 | 241 | −557 | −160 | −1980 | −3883 | 368 | −3830 | −2905 | 1703 | −3415 | −1521 | 1425 | 1426 | 1339 | −3436 | −3999 | 116 | 496 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −2 | −10167 | −11209 | −894 | −1115 | −3522 | −131 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 383 | 140 | 801 | −3346 | 457 | −143 | −339 | 200 | 767 | −2614 | −2652 | −1959 | −2858 | 1142 | 556 | −2897 | 1112 | −419 | 84 | −3183 | 1637 | 497 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −2 | −10167 | −11209 | −894 | −1115 | −3522 | −131 | * | * | | | | | | | | | | | | |
| 384 | −2638 | 1104 | −662 | −1144 | 3027 | −4163 | −2998 | −1979 | −3831 | −375 | −1687 | −3751 | 2766 | −3478 | −3684 | −3244 | −2579 | −435 | −2890 | 274 | 498 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −2 | −10167 | −11209 | −894 | −1115 | −3522 | −131 | * | * | | | | | | | | | | | | |
| 385 | −853 | −3638 | −2297 | −124 | −3882 | 1790 | 2038 | −3581 | −1656 | −305 | −2748 | −930 | −670 | −1610 | 516 | −805 | 1610 | −1006 | −3870 | 950 | 499 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −49 | −10167 | −4939 | −894 | −1115 | −3522 | −131 | * | * | | | | | | | | | | | | |
| 386 | 395 | 3253 | −4872 | −764 | −123 | −4095 | −2965 | 323 | −733 | 682 | −1583 | −3734 | −4146 | −3465 | −3646 | −916 | 181 | 1862 | −2838 | 88 | 500 |
| — | −150 | −501 | 232 | 49 | −382 | 397 | 111 | −627 | 211 | −465 | −722 | 274 | 393 | 48 | 95 | 358 | 119 | −370 | −296 | −251 | |
| C | −1638 | −3816 | −719 | −1947 | −433 | −3659 | −119 | * | * | | | | | | | | | | | | |
| 387 | −3067 | −4023 | −1957 | −2132 | −5207 | −3353 | −2585 | −4985 | 727 | −4795 | −4126 | 924 | 3864 | −2249 | −1995 | −2979 | −3189 | −4414 | −4698 | −4275 | 505 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8771 | −9814 | −894 | −1115 | −2013 | −411 | * | * | | | | | | | | | | | | |
| 388 | 938 | −3179 | −1581 | 328 | −3492 | −2703 | −1362 | 682 | 1325 | −848 | −2270 | 435 | −2796 | 30 | 1412 | −128 | 904 | −2797 | −3367 | −2690 | 506 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −3 | −9395 | −10437 | −894 | −1115 | −4711 | −56 | * | * | | | | | | | | | | | | |
| 389 | −205 | −3065 | −1711 | 1719 | −3309 | 2444 | −1526 | −195 | −35 | −3056 | −2200 | 322 | −2934 | −1107 | −1647 | −1770 | −1786 | −198 | −3323 | −2700 | 507 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −3 | −9395 | −10437 | −894 | −1115 | −847 | −1172 | * | * | | | | | | | | | | | | |
| 390 | −921 | −3780 | −537 | 949 | −4101 | −1294 | −1939 | −3851 | 370 | −3796 | −2869 | −1916 | 2629 | 634 | −197 | 663 | 955 | −1761 | −3963 | −3280 | 508 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10120 | −11162 | −894 | −1115 | −3659 | −119 | * | * | | | | | | | | | | | | |
| 391 | 289 | −3824 | −532 | 1134 | −4146 | 1930 | −1979 | −3898 | −1566 | −3842 | −2917 | 585 | −80 | −1520 | −319 | 1298 | 307 | −3447 | −4009 | −3324 | 509 |
| — | −149 | −500 | 233 | 43 | −381 | 399 | 106 | −626 | 210 | −464 | −720 | 275 | 394 | 45 | 96 | 359 | 117 | −369 | −294 | −249 | |
| T | −94 | −5215 | −4785 | −187 | −3038 | −73 | −4336 | * | * | | | | | | | | | | | | |
| 392 | −1273 | 1985 | 668 | −2747 | 1261 | −3963 | 283 | −2830 | −2610 | −827 | −2381 | −208 | −4039 | −2504 | 1729 | 916 | −983 | −2673 | 3899 | −620 | 511 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10481 | −11523 | −894 | −1115 | −357 | −2191 | * | * | | | | | | | | | | | | |
| 393 | −3952 | −3675 | −6361 | −5774 | 1770 | 1593 | −4627 | 1125 | −5427 | 2056 | −2443 | −5334 | −5615 | −4997 | −5234 | −4807 | −1098 | 458 | −4321 | −4038 | 512 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 394 | −6082 | −6362 | −7082 | −5444 | −7458 | −6270 | −4294 | −6846 | −758 | −6407 | −5805 | −5217 | −6264 | −3903 | 4202 | −5986 | −5716 | −6645 | −6045 | −6162 | 513 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 395 | −1700 | −3843 | −6672 | −6146 | 327 | −6103 | −5199 | 3038 | −5859 | 900 | −20 | −5753 | −6010 | −5509 | −5732 | −5271 | −1170 | 1750 | −4885 | −4559 | 514 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 396 | −543 | 3374 | −5409 | −5086 | −5816 | −1159 | −4905 | −5516 | −4926 | −5740 | −4889 | 1416 | −4992 | −715 | −5122 | 1865 | 2348 | −1315 | −6041 | −5716 | 515 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10521 | −11563 | −894 | −1115 | −701 | −1378 | * | * | | | | | | | | | | | | |
| 397 | 97 | 1559 | −5258 | −4622 | 1468 | −4460 | −3332 | 740 | −4217 | 371 | 2479 | −4106 | 114 | −3840 | −4017 | −3545 | −935 | 1793 | −3197 | 1134 | 516 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2023 | −10521 | −409 | −894 | −1115 | −701 | −1378 | * | * | | | | | | | | | | | | |
| 398 | −1262 | −2167 | −1436 | −946 | −2477 | −2286 | 1802 | −2128 | −851 | −2284 | 1693 | 1116 | −2457 | −796 | −1285 | 1228 | 2490 | −1836 | −2631 | −2084 | 517 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8504 | −9546 | −894 | −1115 | −1192 | −830 | * | * | | | | | | | | | | | | |
| 399 | 3393 | 932 | −6112 | −6454 | −6054 | −3618 | −5399 | −5875 | −6077 | −6140 | −5165 | −4463 | 1016 | −5503 | −5672 | −570 | −3206 | −4549 | −6278 | −6267 | 518 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −3 | −9710 | −10752 | −894 | −1115 | −820 | −1206 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 400 | 1486 | 780 | −632 | −2018 | −3633 | 1992 | 198 | −3279 | −1919 | −1728 | −2612 | 1425 | −3621 | −1858 | −2379 | 145 | 608 | −865 | −3767 | −3203 | 519 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −10220 | −11262 | −894 | −1115 | −92 | −4022 | * | * | | | | | | | | | | | | |
| 401 | −2905 | 769 | −5117 | −4490 | −2708 | 1344 | 2391 | −579 | −1139 | 889 | 2699 | −4039 | −843 | −3762 | −1022 | −1270 | 111 | 770 | −3208 | −2862 | 520 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10521 | −11563 | −894 | −1115 | −701 | −1378 | * | * | | | | | | | | | | | | |
| 402 | −3891 | −5535 | 1714 | −936 | −5807 | −4327 | −3361 | −5621 | −244 | −5536 | −4695 | 643 | 619 | −2961 | −3854 | 1436 | 2699 | −5141 | −5713 | −4900 | 521 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10521 | −11563 | −894 | −1115 | −701 | −1378 | * | * | | | | | | | | | | | | |
| 403 | 216 | −4123 | 1423 | 1349 | −4444 | −3624 | 83 | −1271 | 21 | −1219 | −21 | −149 | 1055 | 319 | 140 | 19 | 413 | −1318 | −4306 | −3624 | 522 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 404 | 1349 | −4124 | 434 | 2190 | −4445 | −559 | −2283 | −4195 | 581 | −4140 | −773 | −171 | −1231 | 618 | −903 | −27 | −864 | −1318 | −4307 | −3624 | 523 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 405 | −1698 | −4121 | 776 | 1633 | −4441 | −1193 | −2283 | −4191 | 393 | −711 | 802 | 1455 | −3718 | 1528 | −903 | −2531 | 1007 | −457 | −4305 | −338 | 524 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 406 | −1413 | 1192 | −990 | −4600 | −2693 | −4455 | −3325 | 1409 | −4199 | 1654 | 1663 | 959 | −4505 | −3826 | −1378 | −1346 | −899 | 1362 | −3196 | −271 | 525 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 407 | −331 | −4124 | 1878 | 1907 | −4445 | −1714 | −493 | −4196 | 925 | −1812 | −3213 | −650 | −794 | 634 | 1148 | −2531 | 251 | −3746 | −4307 | −3624 | 526 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 408 | −1150 | −4064 | −2530 | 1624 | −4358 | −3641 | 1604 | −74 | 36 | −2337 | −18 | 689 | −1392 | 140 | 1588 | −2550 | −990 | 173 | −4264 | 1925 | 527 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 409 | 2097 | −3319 | −5933 | −5328 | 869 | −401 | −4116 | −53 | −4954 | 1897 | −2309 | −4846 | −5189 | −4557 | −4761 | −4297 | −3493 | 834 | −3903 | −3586 | 528 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 410 | 1555 | 2824 | −5774 | −5168 | −3176 | −5034 | −3961 | 1316 | −4793 | 1324 | −362 | −4682 | −5053 | −4429 | −1102 | −4139 | −3334 | 1668 | −3795 | −3451 | 529 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 411 | 86 | −4124 | 1445 | 1964 | −4445 | −437 | 525 | −4196 | 297 | −4140 | −3213 | 91 | −3717 | 889 | 667 | 32 | −263 | −1346 | −4307 | −3624 | 530 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 412 | 1879 | −3267 | −3304 | −2744 | −772 | −1177 | 1066 | −925 | 568 | −3160 | −2438 | −2909 | −4061 | −2508 | 2240 | 237 | −1025 | 189 | −3644 | −476 | 531 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10521 | −11563 | −894 | −1115 | −701 | −1378 | * | * | | | | | | | | | | | | |
| 413 | −5582 | −5000 | −8123 | −7659 | 1086 | −7986 | −7088 | 2908 | −7547 | 1985 | −2573 | −7680 | −7211 | −6595 | −7231 | −7390 | −5493 | 652 | −5672 | −5775 | 532 |
| — | * | * | * | * | * | * | * | * | * | * | * | * | * | * | * | * | * | * | * | * | |
| H | * | * | * | * | * | * | * | * | 0 | | | | | | | | | | | | |
| // | | | | | | | | | | | | | | | | | | | | | |

HMMER2.0 [2.3.2]
NAME AUX_IAA
ACC PF02309.8
DESC AUX/IAA family
LENG 269
ALPH Amino
RF no
CS no
MAP yes
COM hmmbuild -F HMM_ls.ann SEED.ann
COM hmmcalibrate --seed 0 HMM_ls.ann
NSEQ 11
DATE Wed Apr 23 14:47:59 2008
CKSUM 3890
GA −83.0000 −83.0000;
TC −82.0000 −82.0000;
NC −83.5000 −83.5000;
XT −8455 −4 −1000 −1000 −8455 −4 −8455 −4
NULT −4 −8455
NULE 595 −1558 85 338 −294 453 −1158 197 249 902 −1085 −142 −21 −313 45 531 201 384 −1998 −644
EVD −177.830048 0.164010

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | −193 | * | −2999 | | | | | | | | | | | | | | | | | | |
| 1 | −2947 | −2479 | -5371 | −4809 | −1241 | −4959 | −3843 | 1102 | −4560 | 2441 | 2742 | −4635 | −4433 | −3718 | −4232 | −4203 | −2848 | 1143 | −2848 | −2878 | 1 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | −193 | * | | | | | | | | | | | | |
| 2 | 417 | −2549 | −606 | 566 | −3186 | 1483 | −1040 | −2950 | −792 | −2932 | −2059 | 2744 | −2275 | −632 | −1334 | 446 | −1292 | −2444 | −3128 | −2430 | 2 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 3 | −3689 | −3084 | -5627 | -5279 | 3024 | -5347 | −3004 | −873 | −4994 | 2547 | −182 | −4768 | −4717 | −3849 | −4490 | −4714 | −3550 | −1650 | −2024 | −1289 | 3 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 4 | −2445 | −3644 | −1150 | 2315 | −4213 | −2718 | −1438 | −3857 | 3073 | −3629 | −2926 | −1388 | −3002 | −1052 | −739 | −2235 | −2351 | −3491 | −3568 | −3147 | 4 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 5 | 2358 | −1704 | −1682 | 1176 | −2046 | −2379 | −1605 | 1871 | −1564 | −1682 | −1132 | −1583 | −2665 | −1431 | −1882 | −1578 | −1368 | −704 | −2517 | −2066 | 5 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 6 | −2430 | −2823 | −4179 | −4462 | −4591 | −3027 | −4037 | −4454 | −4406 | −4707 | −4191 | −3664 | −3724 | −4237 | −4215 | −2689 | 4010 | −3747 | −4431 | −4588 | 6 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 7 | −4205 | −4417 | −2343 | 3901 | -5349 | −3698 | −3534 | -5837 | −3838 | -5561 | -5237 | −3039 | −4218 | −3453 | −4201 | −4072 | −4352 | -5409 | −4640 | −4860 | 7 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 8 | −4119 | −3542 | -5389 | -5357 | −2027 | −4767 | −4358 | −1609 | -5118 | 3293 | −979 | -5230 | −4771 | −4474 | −4724 | -5069 | −4106 | −2331 | −3412 | −3400 | 8 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 9 | -2287 | -2851 | -3422 | -2614 | -4158 | -2930 | -1828 | -3733 | -569 | -3593 | -2947 | -2354 | -3266 | -1472 | 3856 | -2379 | 707 | -3293 | -3486 | -3366 | 9 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 10 | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 10 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 11 | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 11 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 12 | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 12 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 13 | -1438 | -2041 | -3094 | -3394 | -4272 | -2225 | -3357 | -4272 | -3665 | -4461 | -3622 | -2656 | 4004 | -3348 | -3624 | 347 | -1887 | -3152 | -4374 | -4203 | 13 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 14 | -1779 | 1829 | 872 | 872 | -3722 | 2990 | -1505 | -3506 | -1522 | -3523 | -2747 | -958 | -2627 | -1159 | -2163 | -1639 | -1878 | -3004 | -3752 | -2990 | 14 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -318 | -7942 | -2366 | -894 | -1115 | -701 | -1378 | * | * | | | | | | | | | | | | |
| 15 | 312 | -1985 | 918 | -51 | -2317 | 10 | -393 | 17 | -25 | -2052 | -1172 | 1153 | -1779 | 38 | -525 | 1698 | -651 | -1634 | -2283 | -1637 | 15 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -11 | -7634 | -8676 | -894 | -1115 | -327 | -2302 | * | * | | | | | | | | | | | | |
| 16 | -1056 | -2539 | -499 | 1713 | -2854 | 231 | -652 | -2612 | -299 | -2560 | -1660 | 1017 | -2048 | 1889 | -824 | -916 | 1728 | -2164 | -2736 | -2032 | 16 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -388 | -7942 | -2111 | -894 | -1115 | -701 | -1378 | * | * | | | | | | | | | | | | |
| 17 | -1019 | -2549 | 885 | 1428 | -2845 | 545 | 1683 | -2618 | -299 | -2560 | -1678 | -332 | -1941 | -150 | -859 | 1883 | -984 | -2164 | -2740 | -2002 | 17 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -949 | -7566 | -1068 | -894 | -1115 | -1752 | -508 | * | * | | | | | | | | | | | | |
| 18 | -2023 | -2135 | -2499 | -2712 | -3306 | -2200 | -2597 | -3526 | -2816 | -3517 | -3138 | -2542 | 4110 | -2770 | -2769 | -2249 | -2350 | -3059 | -2925 | -3167 | 18 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -22 | -6638 | -7680 | -894 | -1115 | -2619 | -256 | * | * | | | | | | | | | | | | |
| 19 | 1293 | -1757 | 179 | 2502 | -2356 | -1247 | -455 | -1970 | -255 | -2120 | -1358 | -115 | -1628 | -97 | -744 | -577 | -716 | -1574 | -2401 | -1757 | 19 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -22 | -6638 | -7680 | -894 | -1115 | -2619 | -256 | * | * | | | | | | | | | | | | |
| 20 | -2117 | -2369 | -2441 | -1861 | -2996 | -2357 | -1217 | -2987 | -119 | -2797 | -2289 | -1786 | -2615 | -943 | 3869 | -2167 | -2072 | -2743 | -2456 | -2397 | 20 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -22 | -6638 | -7680 | -894 | -1115 | -2619 | -256 | * | * | | | | | | | | | | | | |
| 21 | -616 | -1918 | 1769 | 1643 | -2150 | -1259 | -206 | -1725 | -9 | -1893 | -1099 | 81 | -1533 | 179 | -565 | -488 | -594 | 1193 | -2199 | -1505 | 21 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -22 | -6638 | -7680 | -894 | -1115 | -1813 | -483 | * | * | | | | | | | | | | | | |
| 22 | -931 | -1946 | 1908 | -181 | -2770 | -1445 | -935 | -2431 | -925 | -2618 | -1886 | -446 | -1932 | -619 | -1471 | -892 | 2936 | -1973 | -2871 | -2223 | 22 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 23 | -1109 | -2751 | 1847 | 2355 | -3025 | -1428 | -555 | -2848 | -504 | -2775 | -1972 | -43 | -1824 | -175 | -1168 | 1222 | -1122 | -2371 | -2966 | -2126 | 23 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 24 | -448 | -1042 | -826 | 1132 | 1300 | -1594 | -271 | -654 | -29 | 507 | -154 | -459 | -1672 | -23 | 1307 | -572 | -383 | -504 | -1315 | -803 | 24 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 25 | -384 | -637 | -1341 | -852 | 1602 | 695 | -561 | -249 | -709 | -593 | 78 | 1327 | -1787 | -551 | -953 | -696 | -373 | 1258 | -1072 | -602 | 25 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | −2638 | −2256 | −3993 | −3845 | −871 | −3609 | −2933 | −361 | −3459 | 3083 | 119 | −3676 | −3610 | −3057 | −3241 | −3452 | −2638 | −926 | −2214 | −2009 | 26 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 27 | 1035 | −942 | −3214 | −2668 | −636 | −2808 | −1823 | 1870 | −2366 | 1824 | 375 | −2384 | −2777 | −2026 | −2306 | −1946 | −1115 | 583 | −1616 | −1337 | 27 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 28 | -565 | −1222 | −1020 | −456 | −1437 | −1607 | −393 | −1050 | 104 | 633 | -520 | -588 | −1765 | −99 | 1537 | 1708 | -544 | −842 | −1634 | −1166 | 28 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 29 | −803 | −2043 | −242 | 10 | −2501 | −1531 | −330 | −2205 | 1608 | −2166 | −1338 | 1738 | 2164 | 79 | −99 | −696 | −771 | −1801 | −2312 | −1726 | 29 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 30 | 919 | −2142 | −1273 | -525 | −2689 | −1937 | −284 | −2237 | 1880 | −2117 | −1340 | −654 | −1992 | 138 | 2561 | −1045 | −992 | −1917 | −2163 | −1799 | 30 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 31 | −366 | −1456 | −476 | −12 | −2084 | 876 | −286 | −1779 | 1381 | −1835 | −973 | −238 | −1542 | 122 | −331 | 1116 | 1225 | −1346 | −2076 | −1486 | 31 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −1644 | -556 | * | * | | | | | | | | | | | | |
| 32 | −616 | -598 | −2131 | −1561 | 1597 | −2030 | −698 | −121 | −1304 | 690 | 208 | −1366 | 910 | −1052 | −1369 | 770 | -558 | −34 | −716 | 1837 | 32 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −15 | −7203 | −8245 | −894 | −1115 | −2223 | −348 | * | * | | | | | | | | | | | | |
| 33 | -587 | 2893 | 2226 | −686 | −2527 | −1419 | −1067 | −2221 | −930 | −2390 | −1574 | −783 | −1896 | −750 | −1363 | 1941 | −787 | −1690 | −2671 | −2133 | 33 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −15 | −7203 | −8245 | −894 | −1115 | −909 | −1097 | * | * | | | | | | | | | | | | |
| 34 | −1769 | −3376 | −15 | 3144 | −3738 | −1959 | −1197 | −3591 | −1201 | −3509 | −2755 | 1022 | 1141 | −841 | −1859 | −1521 | −1816 | −3092 | −3681 | −2824 | 34 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7611 | −8653 | −894 | −1115 | −1670 | -544 | * | * | | | | | | | | | | | | |
| 35 | −707 | −1363 | −1040 | 507 | −1470 | −1854 | -562 | 737 | 1856 | −1257 | -532 | −695 | −1936 | −273 | −702 | −816 | 841 | 1198 | −1743 | −1250 | 35 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −685 | −7611 | −1424 | −894 | −1115 | −1670 | -544 | * | * | | | | | | | | | | | | |
| 36 | −351 | −902 | −1246 | −861 | −1435 | −1376 | −824 | −1034 | −720 | 692 | −600 | −839 | 1365 | −636 | −1011 | 2008 | −486 | −771 | −1783 | −1328 | 36 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −18 | −6944 | −7986 | −894 | −1115 | −2437 | −294 | * | * | | | | | | | | | | | | |
| 37 | -554 | −439 | −2503 | −1915 | 1628 | 780 | −925 | 333 | −1599 | 993 | 487 | −1587 | −2112 | −1286 | −1541 | −1146 | -505 | 1464 | −866 | −471 | 37 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −745 | −6944 | −1339 | −894 | −1115 | −2437 | −294 | * | * | | | | | | | | | | | | |
| 38 | −1880 | −1567 | −2771 | −2762 | 3903 | −2519 | -522 | −754 | −2533 | −412 | −445 | −2106 | −2712 | −2041 | −2341 | −2150 | −1931 | −970 | 96 | 1156 | 38 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −29 | −6227 | −7270 | −894 | −1115 | −2788 | −226 | * | * | | | | | | | | | | | | |
| 39 | −1254 | −1492 | −1693 | −1828 | −2523 | −1576 | −1802 | −2566 | −1884 | −2643 | −2219 | −1711 | 3905 | −1860 | −1931 | −1458 | −1551 | −2160 | −2316 | −2366 | 39 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −29 | −6227 | −7270 | −894 | −1115 | −2788 | −226 | * | * | | | | | | | | | | | | |
| 40 | −1607 | −1392 | −2838 | −2606 | −248 | −2686 | −1862 | 347 | −2180 | 2738 | 655 | −2465 | −2749 | −1988 | −2111 | −2272 | −1618 | -55 | −1452 | −1102 | 40 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −29 | −6227 | −7270 | −894 | −1115 | −1971 | −425 | * | * | | | | | | | | | | | | |
| 41 | 1416 | −840 | −2250 | −1886 | −675 | −1916 | −1395 | 196 | −1593 | 2041 | 265 | −1641 | −2202 | −1428 | −1663 | −1149 | −801 | 108 | −1557 | −1218 | 41 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −22 | −6638 | −7680 | −894 | −1115 | −2619 | −256 | * | * | | | | | | | | | | | | |
| 42 | −937 | −1813 | −707 | −420 | −2466 | −1606 | −497 | −2144 | 2028 | −2141 | −1409 | -580 | 2717 | −133 | 93 | −914 | −946 | −1785 | −2217 | −1814 | 42 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −22 | −6638 | −7680 | −894 | −1115 | −2619 | −256 | * | * | | | | | | | | | | | | |

-continued

| | | | | | | | | | | | | | | | | | | | | |
|---|---|---|---|---|---|---|---|---|---|---|---|---|---|---|---|---|---|---|---|---|
| 43 | −496 | −1315 | −922 | −493 | −2173 | −1340 | −471 | −1891 | 234 | −1946 | −1171 | -555 | −1680 | −118 | 2004 | 2188 | -596 | −1454 | −2086 | −1634 | 43 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −22 | −6638 | −7680 | −894 | −1115 | −2619 | −256 | * | * | | | | | | | | | | | | |
| 44 | −757 | −1328 | −1147 | −608 | −1619 | −1731 | −448 | -588 | 2459 | −1191 | −629 | −706 | −1886 | −129 | 135 | −886 | −722 | 1520 | −1788 | −1360 | 44 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −22 | −6638 | −7680 | −894 | −1115 | −2619 | −256 | * | * | | | | | | | | | | | | |
| 45 | −1149 | −1830 | 2790 | −354 | 2343 | −1718 | -545 | −1517 | −927 | −1541 | −1107 | -587 | −2046 | −629 | −1388 | −1123 | −1174 | −1389 | −1059 | −88 | 45 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −22 | −6638 | −7680 | −894 | −1115 | −2619 | −256 | * | * | | | | | | | | | | | | |
| 46 | −625 | −2038 | 381 | 1681 | −2408 | −1223 | −215 | −2171 | 16 | −2152 | −1310 | 1874 | −1524 | 185 | -532 | 1326 | −623 | −1731 | −2354 | −1628 | 46 |
| — | −149 | -500 | 234 | 43 | −381 | 399 | 105 | −626 | 210 | −466 | −721 | 275 | 394 | 45 | 96 | 359 | 117 | −369 | −295 | −249 | |
| — | −965 | −1050 | −7680 | −125 | −3585 | −2619 | −256 | * | * | | | | | | | | | | | | |
| 47 | 1445 | -516 | −1546 | −1108 | −1011 | −1296 | −832 | 1607 | −932 | −804 | −164 | −941 | −1667 | −777 | −1141 | 1301 | −293 | −46 | −1449 | −1056 | 48 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −22 | −6638 | −7680 | −894 | −1115 | −2619 | −256 | * | * | | | | | | | | | | | | |
| 48 | 1248 | 3000 | −2529 | −2038 | −722 | −1816 | −1262 | 1978 | −1745 | −334 | 149 | −1624 | −2076 | −1490 | −1737 | −998 | −497 | 738 | −1349 | −989 | 49 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −22 | −6638 | −7680 | −894 | −1115 | −925 | −1079 | * | * | | | | | | | | | | | | |
| 49 | -568 | 1551 | −467 | 1864 | −2191 | −1532 | −300 | −1900 | 74 | −1930 | −1052 | 1275 | −1674 | 129 | −419 | 691 | 870 | −1503 | −2166 | −1528 | 50 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −13 | −7426 | −8468 | −894 | −1115 | −1344 | −723 | * | * | | | | | | | | | | | | |
| 50 | −621 | −2045 | 1463 | 762 | −2344 | −1578 | −258 | −2080 | 863 | −2053 | −1144 | −222 | −1684 | 191 | −365 | 594 | 1478 | 18 | −2243 | −1570 | 51 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7566 | −8608 | −894 | −1115 | −1752 | -508 | * | * | | | | | | | | | | | | |
| 51 | 971 | −1910 | −636 | −195 | −2510 | 1277 | -534 | −2238 | 800 | −2245 | −1353 | 879 | −1824 | −106 | −643 | 1406 | −703 | −1770 | −2451 | −1814 | 52 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7566 | −8608 | −894 | −1115 | −1752 | -508 | * | * | | | | | | | | | | | | |
| 52 | −634 | −1816 | −603 | -52 | −2038 | −1647 | 2651 | 77 | 809 | −1783 | −935 | 1665 | −1736 | 1347 | −357 | -574 | -570 | 120 | −2055 | −1452 | 53 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −152 | −7566 | −3398 | −894 | −1115 | −1190 | −832 | * | * | | | | | | | | | | | | |
| 53 | −803 | −1895 | −775 | 1759 | −2103 | −1793 | −418 | 197 | 2158 | −321 | −999 | −492 | −1881 | −14 | −286 | −757 | −730 | −1385 | −2123 | −1564 | 54 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7550 | −8592 | −894 | −1115 | −1779 | −497 | * | * | | | | | | | | | | | | |
| 54 | −628 | −2083 | 967 | 775 | −2394 | −1576 | 1463 | −2140 | 165 | −2093 | −1177 | 1793 | −1682 | 204 | 1269 | -507 | -568 | −1701 | 2428 | −1587 | 55 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7550 | −8592 | −894 | −1115 | −1779 | −497 | * | * | | | | | | | | | | | | |
| 55 | −696 | −1704 | −609 | 995 | −1943 | 11 | −474 | −1580 | −181 | −1728 | −921 | 1119 | −1828 | −102 | −650 | −682 | 1164 | 1676 | −2068 | −1492 | 56 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7550 | −8592 | −894 | −1115 | −1779 | −497 | * | * | | | | | | | | | | | | |
| 56 | 609 | −756 | −1923 | −1358 | 1262 | −2001 | 1446 | −324 | −1147 | −655 | 15 | −1288 | −2101 | −956 | −1311 | 1484 | −606 | 1375 | −1200 | −798 | 57 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7550 | −8592 | −894 | −1115 | −1779 | −497 | * | * | | | | | | | | | | | | |
| 57 | 1700 | 2274 | −3519 | −3524 | −3438 | −1557 | −2861 | −3124 | −3256 | −3435 | −2569 | −2204 | −2324 | −2877 | −3126 | 2877 | −1082 | −2181 | −3715 | −3541 | 58 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7550 | −8592 | −894 | −1115 | −290 | −2456 | * | * | | | | | | | | | | | | |
| 58 | 365 | 3467 | −3137 | −2741 | −2076 | 1278 | −2108 | −1633 | −2492 | −1977 | −1273 | −2151 | 1592 | −2221 | −2527 | −1277 | 882 | 1044 | −2499 | −2168 | 59 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 59 | −830 | −1788 | −935 | −398 | −1974 | 1291 | −602 | −1609 | 597 | -504 | −960 | 2220 | −1989 | −234 | −726 | −834 | 651 | −26 | −2114 | −1559 | 60 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −159 | −7942 | −3315 | −894 | −1115 | −701 | −1378 | * | * | | | | | | | | | | | | |

-continued

| | | | | | | | | | | | | | | | | | | | | |
|---|---|---|---|---|---|---|---|---|---|---|---|---|---|---|---|---|---|---|---|---|
| 60 | −1457 | −2680 | −1373 | −748 | −3182 | −2285 | −720 | −2800 | 2797 | −2653 | −1825 | 653 | −2357 | −282 | 977 | 1300 | −1342 | −2421 | −2699 | −2240 | 61 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −10 | −7792 | −8834 | −894 | −1115 | −1247 | −789 | * | * | | | | | | | | | | | | |
| 61 | −940 | −2108 | −951 | −485 | −2748 | −1850 | −743 | −2456 | −250 | −2453 | −1579 | 2580 | −2064 | −320 | 1673 | 1082 | 826 | −1999 | −2637 | −2046 | 62 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −307 | −7792 | −2417 | −894 | −1115 | −1247 | −789 | * | * | | | | | | | | | | | | |
| 62 | −865 | −1649 | −1230 | −1297 | −3345 | 2183 | −1762 | −3108 | −1718 | −3246 | −2402 | 2789 | −2246 | −1485 | −2088 | −987 | 1280 | −2321 | −3455 | −2971 | 63 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −453 | −7497 | −1921 | −894 | −1115 | −1241 | −793 | * | * | | | | | | | | | | | | |
| 63 | 817 | −1591 | −392 | 1509 | 2013 | −1555 | −357 | −1427 | −101 | −1575 | −787 | 1020 | −1718 | -5 | -570 | -595 | -572 | −1153 | −1893 | −1294 | 64 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −14 | −7237 | −8280 | −894 | −1115 | −213 | −2866 | * | * | | | | | | | | | | | | |
| 64 | 395 | −1831 | −1143 | −606 | −2276 | −1891 | −801 | −1908 | 2597 | −2054 | −1235 | −819 | −2082 | −424 | −873 | 425 | 724 | 375 | −2376 | −1825 | 65 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 65 | −1358 | −2769 | 2069 | −465 | −3152 | 300 | −793 | −2861 | 1851 | −2759 | −1894 | −755 | −2279 | −357 | 2039 | −1213 | −1288 | −2436 | −2871 | −2260 | 66 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −116 | −7942 | −3775 | −894 | −1115 | −701 | −1378 | * | * | | | | | | | | | | | | |
| 66 | −724 | −2079 | 789 | −66 | −2353 | −1713 | −379 | −2071 | 948 | −258 | −1181 | 736 | −1807 | 1547 | −476 | −627 | 1284 | 490 | −2291 | −1638 | 67 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7835 | −8877 | −894 | −1115 | −1115 | −894 | * | * | | | | | | | | | | | | |
| 67 | −972 | −838 | −3017 | −2395 | −701 | −2493 | −1336 | −209 | 1107 | 1103 | 2709 | −2032 | −2527 | −1709 | −1913 | −1569 | −910 | 1385 | 2423 | −935 | 68 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7835 | −8877 | −894 | −1115 | −492 | −1792 | * | * | | | | | | | | | | | | |
| 68 | −833 | −2203 | 1367 | −153 | −2506 | 159 | −487 | −2231 | −87 | −303 | −1327 | −456 | 807 | −44 | 2001 | 129 | −778 | −1822 | −2429 | −1771 | 69 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 69 | −780 | −2099 | −685 | 1492 | −2360 | −1776 | −444 | −2069 | -51 | −2090 | 1057 | 945 | −1869 | 1649 | -547 | 462 | 268 | 770 | −2321 | −1676 | 70 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 70 | 83 | −1009 | −33 | −1448 | 2429 | 159 | −1046 | -573 | −1267 | 860 | −221 | −1427 | −2297 | −1086 | −1465 | −1240 | 992 | −459 | −1455 | −1062 | 71 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 71 | 700 | −1635 | −3702 | −3780 | −4060 | −1911 | −3273 | −3808 | −3626 | −4078 | −3163 | −2541 | −2690 | −3246 | −3522 | 3166 | 1266 | −2700 | −4285 | −4138 | 72 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 72 | −1589 | −3213 | 1112 | 2538 | −3486 | 1213 | −1073 | −3292 | −915 | −3214 | −2366 | −674 | −2390 | 893 | −1533 | 483 | −1577 | −2819 | −3392 | −2592 | 73 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 73 | 319 | −1877 | 337 | 502 | −2062 | −1828 | -507 | 744 | 1573 | −1833 | 1455 | -538 | 475 | −110 | −638 | −752 | −725 | 197 | −2148 | −1560 | 74 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 74 | −792 | −2258 | 1081 | 1527 | −2577 | −1759 | −420 | −2325 | 1424 | −2272 | 1385 | −395 | −1855 | 38 | 824 | 709 | −731 | −1879 | −2441 | −1761 | 75 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 75 | 423 | −1307 | 229 | −882 | −1394 | 733 | −835 | 866 | −748 | −1242 | -524 | −1025 | −2142 | −641 | −1102 | 319 | 1388 | 843 | −1733 | −1282 | 76 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 76 | 516 | −1915 | −1159 | 983 | −2630 | −10 | −1024 | −2310 | −729 | −2419 | −1574 | −935 | −2169 | −643 | −1188 | 2442 | −1008 | 40 | −2704 | −2133 | 77 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 77 | −990 | −1014 | −2924 | −2384 | −1172 | −128 | −1568 | 1234 | −2102 | −1007 | −378 | −2035 | −2568 | −1829 | −2101 | 1310 | 751 | 2189 | −1674 | −1318 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 78 | 349 | −2115 | 439 | 611 | −2383 | −1770 | −435 | −2097 | −39 | −2108 | −1219 | −428 | −1862 | 5 | 725 | 1069 | 1096 | 192 | −2331 | 899 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 79 | 370 | −2190 | −641 | 1109 | −2490 | −333 | −418 | −2225 | 1644 | −370 | −1287 | −401 | 359 | 34 | −510 | 140 | 558 | −1801 | −2389 | −1721 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −103 | −7942 | −3949 | −894 | −1115 | −701 | −1378 | * | * | | | | | | | | | | | | |
| 80 | 883 | −2220 | 1487 | 849 | −2532 | 97 | −391 | −2279 | 16 | −2233 | −1314 | 1370 | −1819 | 64 | 494 | −641 | −702 | −210 | −2409 | −1727 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −233 | −7848 | −2787 | −894 | −1115 | −1072 | −932 | * | * | | | | | | | | | | | | |
| 81 | 728 | −1717 | −993 | −499 | −2509 | 1340 | −756 | −2215 | 977 | −2279 | −1404 | −690 | −1915 | −352 | −859 | 1088 | 1497 | −1735 | −2521 | −1937 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1953 | −7626 | −441 | −894 | −1115 | −1641 | −558 | * | * | | | | | | | | | | | | |
| 82 | −310 | −1040 | 256 | 155 | −1405 | −812 | −283 | −1507 | −119 | −1688 | −1080 | 3006 | −1284 | −79 | −430 | −338 | −471 | −1137 | −1571 | −972 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −41 | −5714 | −6756 | −894 | −1115 | −2926 | −204 | * | * | | | | | | | | | | | | |
| 83 | −1301 | −1085 | −1863 | −1724 | 634 | −1658 | −307 | −942 | −1231 | −752 | −570 | −1433 | −1941 | −1221 | −1190 | −1529 | −1347 | −976 | 5274 | 987 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −41 | −5714 | −6756 | −894 | −1115 | −2926 | −204 | * | * | | | | | | | | | | | | |
| 84 | −659 | −720 | −1743 | −1420 | −70 | −1758 | −955 | 616 | −988 | 780 | 3648 | −1323 | −1949 | −969 | −1066 | −1111 | −708 | 404 | −1038 | −617 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −41 | −5714 | −6756 | −894 | −1115 | −2926 | −204 | * | * | | | | | | | | | | | | |
| 85 | −1138 | −969 | −2053 | −1919 | 3350 | −1960 | −173 | −37 | −1692 | 196 | 209 | −1478 | −2145 | −1337 | −1629 | −1456 | −1178 | −220 | 344 | 1362 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −41 | −5714 | −6756 | −894 | −1115 | −2926 | −204 | * | * | | | | | | | | | | | | |
| 86 | −416 | −776 | −795 | −835 | −1626 | −887 | −883 | −1494 | −839 | −1647 | −1181 | −784 | 3363 | −834 | −975 | −597 | −668 | −1156 | −1599 | −1452 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −41 | −5714 | −6756 | −894 | −1115 | −2166 | −364 | * | * | | | | | | | | | | | | |
| 87 | −632 | −1793 | 524 | 2103 | −2359 | 1684 | −317 | −2122 | −183 | −2170 | −1413 | 104 | −1482 | 25 | −696 | −517 | −700 | −1691 | −2331 | −1695 | 88 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −29 | −6227 | −7270 | −894 | −1115 | −2788 | −226 | * | * | | | | | | | | | | | | |
| 88 | 1494 | −488 | −1992 | −1597 | −767 | −1724 | −1213 | 2195 | −1363 | −138 | 179 | −1389 | −2001 | −1224 | −1493 | −932 | −488 | 955 | −1526 | −1133 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −29 | −6227 | −7270 | −894 | −1115 | −1480 | −640 | * | * | | | | | | | | | | | | |
| 89 | 1804 | −2047 | 138 | 1534 | −2480 | −1379 | −402 | −2212 | −170 | −2233 | −1400 | 1699 | −1685 | −9 | −702 | −617 | −750 | −1785 | −2460 | −1765 | 90 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −18 | −6939 | −7981 | −894 | −1115 | −2441 | −294 | * | * | | | | | | | | | | | | |
| 90 | 1831 | −944 | −988 | −575 | −1338 | −1418 | −609 | −871 | −463 | −1159 | 2326 | 1571 | −1705 | −384 | −797 | −534 | −436 | −640 | −1656 | −1192 | 91 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −18 | −6939 | −7981 | −894 | −1115 | −2441 | −294 | * | * | | | | | | | | | | | | |
| 91 | −449 | −1732 | 1354 | 1343 | −1975 | −1350 | −101 | −1667 | 235 | −1716 | 1970 | −19 | −1497 | 317 | −270 | −357 | 1097 | −1307 | −1975 | −1328 | 92 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −18 | −6939 | −7981 | −894 | −1115 | −2441 | −294 | * | * | | | | | | | | | | | | |
| 92 | −451 | −1530 | −321 | 128 | −1733 | −1416 | −138 | −1406 | 245 | 282 | −692 | 1470 | 1076 | 1675 | −185 | −411 | −398 | −1107 | −1804 | −1218 | 93 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −339 | −6939 | −2312 | −894 | −1115 | −2441 | −294 | * | * | | | | | | | | | | | | |
| 93 | −374 | −965 | −1587 | −1709 | −2488 | −1139 | −1726 | −2483 | −1808 | −2720 | −2020 | −1300 | −1825 | −1663 | −1914 | 3241 | −760 | −1740 | −2677 | −2294 | 94 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −22 | −6621 | −7664 | −894 | −1115 | −2627 | −255 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 94 | −494 | −744 | −1993 | −1741 | −1272 | −1602 | −1425 | 164 | −1535 | −814 | −411 | −1455 | 1760 | −1424 | −1652 | −894 | −672 | 2601 | −1889 | −1490 | 95 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −22 | −6621 | −7664 | −894 | −1115 | −1620 | -568 | * | * | | | | | | | | | | | | |
| 95 | −407 | −1534 | −393 | 148 | −1747 | −1423 | 1700 | −1412 | 1281 | −1501 | −666 | 1042 | −1517 | 312 | −142 | −361 | 1018 | 686 | −1790 | −1201 | 96 |
| — | −149 | -500 | 233 | 43 | −381 | 398 | 106 | −626 | 212 | −466 | −721 | 275 | 394 | 45 | 96 | 359 | 117 | −368 | −295 | −249 | |
| — | −2199 | −1515 | −1209 | −131 | −3529 | −1042 | −959 | * | * | | | | | | | | | | | | |
| 96 | −1011 | −1893 | −1118 | −631 | −2608 | −1785 | -525 | −2141 | 2913 | −2169 | −1430 | −740 | −2004 | −137 | 242 | −1000 | 1456 | −1796 | −2298 | −1908 | 98 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 97 | −1180 | −2471 | 3198 | 68 | −3219 | −1438 | −919 | −3116 | −1056 | −3116 | −2386 | −264 | −1969 | -599 | −1749 | 1359 | −1326 | −2545 | −3268 | −2449 | 99 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 98 | -549 | −989 | −1228 | −699 | −1237 | −1698 | -593 | −334 | 1357 | −957 | −316 | −789 | −1862 | −371 | -521 | −770 | 1329 | 1926 | −1576 | −1144 | 100 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 99 | −350 | −1320 | -528 | −72 | −1826 | −1324 | 2363 | −1504 | 8 | −1623 | −799 | −284 | 1117 | 59 | −430 | 1017 | 1316 | −1140 | −1924 | −1359 | 101 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 100 | −761 | −1736 | −768 | −206 | 1511 | −1695 | −210 | −1591 | 2213 | −1611 | −868 | −415 | −1778 | 1781 | 183 | −722 | −672 | −1333 | −1712 | −1102 | 102 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 101 | −343 | −1168 | −830 | −601 | −2357 | −1216 | −885 | −2056 | −671 | −2202 | −1368 | 1734 | −1692 | -559 | −1063 | 1277 | 2406 | −1494 | −2474 | −1962 | 103 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 102 | −946 | −917 | −2322 | −1718 | −715 | −2404 | −1169 | 2289 | 1239 | 1111 | 234 | −1645 | −2404 | −1167 | −1189 | −1491 | −881 | 360 | −1451 | −1109 | 104 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 103 | −1184 | −2001 | −720 | −712 | −2693 | −1747 | −1058 | −2597 | -592 | −2590 | −1920 | −886 | 3285 | 2091 | −839 | −1191 | −1305 | −2181 | −2653 | −2177 | 105 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 104 | 966 | −1977 | −198 | 1347 | −2337 | −1464 | −181 | −2032 | 2145 | −2001 | −1143 | −133 | −1625 | 247 | -54 | -528 | -590 | −1632 | −2172 | −1554 | 106 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 105 | −603 | −1557 | −222 | 2106 | −1944 | 887 | −459 | −1435 | −230 | −1716 | −956 | −296 | −1703 | −112 | −693 | -599 | −625 | 1108 | −2097 | −1516 | 107 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −1424 | −673 | * | * | | | | | | | | | | | | |
| 106 | -518 | −1972 | 739 | 192 | −2300 | −1476 | 1590 | −2040 | 1283 | −1980 | −1063 | −113 | 825 | 1516 | 1111 | −398 | −454 | −1599 | −2141 | −1475 | 108 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −14 | −7290 | −8332 | −894 | −1115 | −1510 | −624 | * | * | | | | | | | | | | | | |
| 107 | -569 | −1727 | -515 | 783 | −1969 | −1572 | −283 | −1641 | 75 | −1726 | −882 | −284 | −1683 | 1155 | −401 | 1638 | 908 | 545 | −2014 | −1408 | 109 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −12 | −7443 | −8485 | −894 | −1115 | −1155 | −860 | * | * | | | | | | | | | | | | |
| 108 | −774 | −2032 | −694 | −138 | −2305 | −1747 | 2453 | −1995 | 1156 | −70 | −1146 | −416 | −1835 | 1102 | −262 | 1587 | −703 | −1634 | −2219 | −1618 | 110 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7626 | −8668 | −894 | −1115 | −1018 | −982 | * | * | | | | | | | | | | | | |
| 109 | 431 | −1605 | −826 | 833 | −1742 | 626 | 1329 | 117 | −171 | −31 | −748 | -529 | −1859 | −108 | −623 | 496 | 681 | −1126 | −1912 | −1364 | 111 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −10 | −7748 | −8790 | −894 | −1115 | −1366 | −708 | * | * | | | | | | | | | | | | |
| 110 | −765 | −1611 | −1047 | -520 | −1923 | 762 | −675 | −1534 | 1570 | −1721 | −935 | −728 | 689 | −333 | −772 | −814 | 741 | 1485 | −2093 | −1569 | 112 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −10 | −7748 | −8790 | −894 | −1115 | −401 | −2044 | * | * | | | | | | | | | | | | |

-continued

| | | | | | | | | | | | | | | | | | | | | |
|---|---|---|---|---|---|---|---|---|---|---|---|---|---|---|---|---|---|---|---|---|
| 111 | 372 | −2322 | -588 | 1575 | −2645 | 710 | −478 | −2396 | 1636 | −2343 | −1424 | 918 | −1901 | −24 | -583 | 216 | −797 | −1948 | −2514 | −1827 | 113 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 112 | −1262 | −2623 | 1722 | −408 | −3186 | 1427 | −991 | −2957 | −742 | −2924 | −2047 | 1032 | −2257 | -577 | −1295 | 1069 | 1482 | −2458 | −3113 | −2398 | 114 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 113 | −830 | −2185 | 1103 | 1522 | −2459 | −1793 | −482 | −2176 | −97 | −378 | −1294 | −449 | 477 | −43 | −600 | 1384 | −772 | −212 | −2403 | −1746 | 115 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 114 | 1154 | −2023 | −992 | −473 | −2633 | −1826 | −751 | −2346 | −360 | −2376 | −1490 | 919 | −2032 | −327 | 1213 | 1758 | 950 | −1894 | −2597 | −1984 | 116 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 115 | 1014 | −2054 | −741 | −195 | −2327 | −1797 | −484 | −2024 | 1675 | −305 | −1193 | 877 | −1898 | -55 | -579 | 844 | 651 | −1657 | −2312 | −1683 | 117 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −116 | −7942 | −3775 | −894 | −1115 | −701 | −1378 | * | * | | | | | | | | | | | | |
| 116 | 1975 | −1562 | −3311 | −3391 | −3933 | −1821 | −3064 | −3701 | −3357 | −3947 | −3038 | −2363 | 3098 | −3001 | −3323 | 1196 | −1377 | −2611 | −4148 | −3966 | 118 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7835 | −8877 | −894 | −1115 | −492 | −1792 | * | * | | | | | | | | | | | | |
| 117 | −1580 | −1656 | −3672 | −3323 | −1788 | −2859 | −2611 | −448 | −2954 | −1042 | 1585 | −2834 | 3410 | −2753 | −2923 | −2119 | −1717 | 1487 | −2652 | −2316 | 119 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −159 | −7942 | −3315 | −894 | −1115 | −701 | −1378 | * | * | | | | | | | | | | | | |
| 118 | 1492 | −2086 | 550 | 698 | −2365 | −1706 | −389 | −2082 | 2 | −2088 | −1198 | −364 | 1396 | 51 | 513 | −637 | −676 | 234 | −2306 | −1652 | 120 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | -569 | −7792 | −1638 | −894 | −1115 | −441 | −1924 | * | * | | | | | | | | | | | | |
| 119 | 2169 | −1825 | −655 | −261 | −2466 | −1595 | -584 | −2174 | 910 | −2211 | −1344 | 1021 | −1842 | −173 | −643 | 850 | −729 | −1724 | −2435 | −1830 | 121 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −12 | −7452 | −8494 | −894 | −1115 | −259 | −2607 | * | * | | | | | | | | | | | | |
| 120 | −4125 | −4091 | −4017 | −3615 | -5101 | −3960 | −2958 | -5182 | 3972 | −4825 | −4345 | −3552 | −4249 | −2709 | −1809 | −4154 | −4044 | −4895 | −4132 | −4389 | 122 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 121 | 2764 | −1712 | −2512 | −2299 | −3574 | −1909 | −2350 | −3303 | −2295 | −3485 | −2607 | 1592 | −2555 | −2104 | −2563 | 678 | 923 | −2474 | −3731 | −3360 | 123 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 122 | −2740 | −3536 | −2261 | −1808 | −4262 | −3114 | −1408 | −3815 | 1496 | −3500 | −2847 | −1861 | −3239 | 4039 | −202 | −2600 | −2538 | −3537 | −3332 | −3130 | 124 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 123 | 268 | −1861 | −4935 | −4578 | −2490 | −4579 | −4364 | 2671 | −4464 | −1384 | −1256 | −4297 | −4452 | −4346 | −4547 | −3891 | −2305 | 2774 | −3952 | −3477 | 125 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 124 | −2838 | −2616 | −4834 | −4880 | −3213 | −3955 | −4416 | −610 | −4757 | −2310 | −2253 | −4383 | −4345 | −4643 | −4642 | −3732 | −3007 | 3763 | −4157 | −3886 | 126 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 125 | −4088 | −3924 | −4774 | -5139 | -5615 | 3825 | −4753 | −6303 | -5453 | −6014 | -5662 | −4812 | −4539 | -5232 | -5106 | −4370 | −4472 | -5527 | −4696 | -5561 | 127 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 126 | -5598 | −4432 | -5385 | -5722 | −3380 | −4524 | −4140 | -5941 | -5643 | -5318 | -5354 | -5427 | −4938 | -5474 | -5178 | -5909 | -5751 | -5890 | 6275 | −2993 | 128 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 127 | −4497 | −4117 | −4899 | -5251 | -5560 | −4139 | −4798 | −6328 | -5454 | -5976 | -5741 | -5026 | 4302 | -5328 | -5104 | −4798 | −4844 | -5739 | −4665 | -5484 | 129 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 128 | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 130 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 129 | -2454 | -1957 | -5123 | -4806 | -2583 | -4915 | -4898 | 2605 | -4752 | -1355 | -1296 | -4602 | -4686 | -4684 | -4897 | -4287 | -2450 | 3067 | -4290 | -3786 | 131 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 130 | -2748 | 3830 | -4416 | -3730 | -4308 | -3282 | -2795 | -4179 | -1740 | -4165 | -3597 | -3273 | -3742 | -2579 | 3677 | -2940 | -2956 | -3724 | -3878 | -3874 | 132 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 131 | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 133 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 132 | -4609 | -3570 | -5024 | -5362 | 2535 | -4897 | -1137 | -3495 | -4925 | -2817 | -2908 | -3545 | -4766 | -3679 | -4306 | -4162 | -4471 | -3659 | -385 | 4425 | 134 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 133 | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 135 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 134 | -3026 | -3582 | -3851 | -2340 | -4536 | -3447 | -1304 | -3819 | 3629 | -3424 | -2785 | -2164 | -3384 | -889 | 1433 | -2903 | -2669 | -3611 | -3211 | -3177 | 136 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 135 | -2488 | -3492 | -1364 | -1377 | -4198 | -2771 | -1608 | -3981 | 2043 | -3763 | -3089 | 3669 | -3109 | -1245 | -834 | -2340 | -2461 | -3576 | -3621 | -3223 | 137 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 136 | -835 | -2058 | -786 | -253 | -2348 | -1828 | -533 | -2038 | 875 | -2087 | 1498 | 2028 | -1940 | -110 | -604 | 1286 | 1264 | -1677 | -2339 | -1722 | 138 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -116 | -7942 | -3775 | -894 | -1115 | -701 | -1378 | * | * | | | | | | | | | | | | |
| 137 | -865 | -722 | -2990 | -2372 | -674 | -2397 | -1261 | 710 | -2017 | 1327 | 2685 | 722 | -2445 | -1682 | -1897 | 13 | -807 | 1180 | -1191 | -845 | 139 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7835 | -8877 | -894 | -1115 | -492 | -1792 | * | * | | | | | | | | | | | | |
| 138 | 1772 | -1752 | -919 | -371 | -1902 | -1877 | 1230 | -1539 | -260 | -1695 | 1161 | 877 | -1967 | 1830 | -710 | -814 | -748 | 36 | -2055 | -1501 | 140 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -683 | -7942 | -1423 | -894 | -1115 | -701 | -1378 | * | * | | | | | | | | | | | | |
| 139 | -473 | -977 | -2303 | -1976 | -2092 | -1477 | -1693 | -1408 | -1798 | -1932 | -1229 | -1537 | -2050 | -1613 | -1958 | 2301 | 1959 | 1227 | -2468 | -2114 | 141 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -242 | -7273 | -2754 | -894 | -1115 | -2151 | -368 | * | * | | | | | | | | | | | | |
| 140 | -772 | -2032 | -518 | -54 | -2456 | -1615 | -239 | -2134 | 1785 | -2069 | -1222 | -306 | -1746 | 1835 | 140 | 1704 | -703 | -1742 | -2196 | -1642 | 142 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -772 | -7047 | -1298 | -894 | -1115 | -2360 | -312 | * | * | | | | | | | | | | | | |
| 141 | -825 | -1899 | -527 | -44 | -2343 | -1532 | 22 | -1960 | 2201 | -1837 | -1078 | -222 | -1641 | 2407 | 830 | -716 | -701 | -1642 | -1885 | -1469 | 143 |
| — | -149 | -500 | 232 | 42 | -381 | 399 | 105 | -627 | 211 | -467 | -721 | 278 | 395 | 47 | 95 | 360 | 117 | -370 | -295 | -250 | |
| — | -580 | -1621 | -7345 | -2597 | -261 | -1507 | -626 | * | * | | | | | | | | | | | | |
| 142 | -221 | -857 | -1942 | -1852 | -2688 | -1112 | -1767 | -2352 | -1792 | -2638 | -1820 | -1322 | -1799 | -1612 | -1941 | 2384 | 2544 | -1588 | -2922 | -2589 | 151 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 143 | -343 | 2506 | -993 | 1154 | -1049 | -1495 | -457 | -539 | -360 | -883 | -171 | -599 | -1675 | -257 | -706 | 921 | -345 | 1151 | -1388 | -937 | 152 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 144 | -564 | -1588 | -617 | -202 | -2278 | 990 | -398 | -1937 | 2192 | -1982 | -1153 | -396 | -1694 | -2 | -161 | -552 | 1391 | -1517 | -2188 | -1658 | 153 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 145 | −1331 | −2901 | 433 | 2491 | −3202 | −1508 | −731 | −3074 | −704 | −3007 | −2270 | 2727 | −1963 | −381 | −1324 | −1083 | −1372 | −2602 | −3148 | −2317 | 154 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 146 | -554 | −1745 | −104 | 2163 | −2295 | −1342 | −362 | −2003 | −69 | −2051 | −1203 | −170 | −1621 | 37 | -564 | 1056 | 1254 | −1570 | −2290 | −1643 | 155 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −2432 | −296 | * | * | | | | | | | | | | | | |
| 147 | 1227 | −1744 | 2425 | −36 | −2635 | −1306 | −660 | −2377 | -517 | −2433 | −1597 | −290 | −1726 | −292 | −1056 | 1267 | −761 | −1841 | −2665 | −2000 | 156 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −17 | −6952 | −7994 | −894 | −1115 | −1466 | −648 | * | * | | | | | | | | | | | | |
| 148 | −1547 | −2909 | −263 | 2972 | −3324 | −1927 | −794 | −3041 | 1733 | −2912 | −2153 | -580 | −2235 | −405 | -501 | −1347 | −1501 | −2639 | −2968 | −2385 | 157 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −14 | −7273 | −8315 | −894 | −1115 | −663 | −1441 | * | * | | | | | | | | | | | | |
| 149 | 498 | −2059 | -549 | 918 | −2343 | −1672 | −348 | −2063 | 1021 | −2062 | −1168 | 1810 | −1773 | 94 | −446 | 241 | −638 | 994 | −2274 | −1619 | 158 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −10 | −7736 | −8778 | −894 | −1115 | −391 | −2075 | * | * | | | | | | | | | | | | |
| 150 | −1976 | −3729 | 1863 | 2823 | −3957 | −2181 | −1353 | −3809 | 805 | −3704 | −2924 | 1223 | −2611 | −982 | −2058 | −1705 | −1995 | −3315 | −3885 | −2995 | 159 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 151 | 1763 | −1650 | −3642 | −3798 | −4181 | 2220 | −3341 | −3977 | −3752 | −4222 | −3282 | −2551 | −2699 | −3320 | −3626 | 2212 | −1485 | −2778 | −4391 | −4266 | 160 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −325 | −7942 | −2338 | −894 | −1115 | −701 | −1378 | * | * | | | | | | | | | | | | |
| 152 | −784 | −2199 | -572 | 700 | −2542 | 366 | −357 | −2267 | 1096 | −2208 | −1307 | −356 | −1817 | 93 | 1007 | 1909 | −718 | −1838 | −2364 | −1721 | 161 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7627 | −8670 | −894 | −1115 | −1638 | -559 | * | * | | | | | | | | | | | | |
| 153 | −1755 | −2780 | −1424 | −982 | −3243 | −2409 | 1655 | −2950 | 2264 | −2799 | −2046 | −1140 | 2883 | −483 | −24 | −1650 | −1642 | −2615 | −2769 | −2356 | 162 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | -521 | −7627 | −1745 | −894 | −1115 | −324 | −2315 | * | * | | | | | | | | | | | | |
| 154 | −1786 | −3580 | 1253 | 2500 | −3798 | 1582 | −1138 | −3672 | −1233 | −3563 | −2815 | 1553 | −2365 | −780 | −1990 | −1494 | −1823 | −3167 | −3753 | −2821 | 163 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −213 | −7550 | −2923 | −894 | −1115 | −1779 | −497 | * | * | | | | | | | | | | | | |
| 155 | -528 | −1123 | −977 | −444 | −1256 | 1292 | −482 | −841 | −310 | 280 | −356 | −618 | −1796 | 1459 | −688 | 672 | −493 | 499 | −1551 | −1076 | 164 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −13 | −7350 | −8392 | −894 | −1115 | −2063 | −394 | * | * | | | | | | | | | | | | |
| 156 | −1097 | −2577 | 1176 | 37 | −2950 | 1967 | −665 | −2731 | −477 | −2688 | −1844 | −304 | 1179 | 1967 | −1058 | −927 | −1100 | −2269 | −2882 | −2127 | 165 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −13 | −7350 | −8392 | −894 | −1115 | −756 | −1294 | * | * | | | | | | | | | | | | |
| 157 | 2145 | 2685 | −3556 | −3388 | −2668 | 2048 | −2602 | −2092 | −3096 | −2568 | −1842 | −2293 | −2472 | −2736 | −2983 | −1106 | −1164 | 807 | −3074 | −2808 | 166 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −10 | −7720 | −8763 | −894 | −1115 | −379 | −2113 | * | * | | | | | | | | | | | | |
| 158 | −976 | −841 | −3052 | −2440 | −767 | −2501 | −1367 | 2038 | −2090 | 1386 | 2282 | 169 | −2548 | −1764 | −1986 | 270 | −918 | −168 | −1305 | −962 | 167 |
| — | −149 | -500 | 233 | 43 | −381 | 400 | 106 | −626 | 210 | −466 | −720 | 275 | 394 | 45 | 96 | 359 | 117 | −369 | −294 | −249 | |
| — | −155 | −3326 | −8984 | −220 | −2824 | −701 | −1378 | * | * | | | | | | | | | | | | |
| 159 | −4612 | −3570 | -5027 | -5365 | 3420 | −4900 | −1135 | −3495 | −4928 | −2817 | −2907 | −3544 | −4767 | −3678 | −4307 | −4162 | −4473 | −3659 | −383 | 3928 | 169 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 160 | −2380 | −2010 | −4897 | −4562 | −2123 | −4360 | −4085 | 361 | −4323 | −966 | 1564 | −4214 | −4328 | −4090 | −4298 | −3698 | −2405 | 3499 | −3572 | −3202 | 170 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 161 | −4125 | −4091 | −4017 | −3615 | -5101 | −3960 | −2958 | -5182 | 3972 | −4825 | −4345 | −3552 | −4249 | −2709 | −1809 | −4154 | −4044 | −4895 | −4132 | −4389 | 171 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 162 | -2838 | -2616 | -4834 | -4880 | -3213 | -3955 | -4416 | -610 | -4757 | -2310 | -2253 | -4383 | -4345 | -4643 | -4642 | -3732 | -3007 | 3763 | -4157 | -3886 | 172 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 163 | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 173 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 164 | -3870 | -3616 | -4923 | -5074 | -3041 | -4123 | -4208 | -2775 | -4736 | -2183 | 5292 | -4720 | -4529 | -4612 | -4478 | -4340 | -4085 | -3170 | -3793 | -3651 | 174 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 165 | -2689 | -4635 | 3805 | 1052 | -4824 | -2408 | -1881 | -4857 | -2312 | -4685 | -4144 | -1016 | -3001 | -1583 | -3307 | -2298 | -2797 | -4296 | -4798 | -3747 | 175 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 166 | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 176 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 167 | 3317 | -1708 | -3973 | -4078 | -3410 | -2176 | -3406 | -1858 | -3832 | -2969 | -2503 | -2804 | -2913 | -3485 | -3656 | -1541 | -1635 | 761 | -3989 | -3742 | 177 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 168 | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 178 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 169 | -4592 | -3568 | -5012 | -5345 | 1524 | -4882 | -1148 | -3485 | -4912 | -2812 | -2901 | -3549 | -4761 | -3681 | -4301 | -4158 | -4461 | -3650 | -397 | 4655 | 179 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 170 | -3651 | -3064 | -5938 | -5374 | -1120 | -5684 | -4336 | -611 | -5088 | 3059 | 2168 | -5433 | -4786 | -3927 | -4594 | -5078 | -3497 | -1435 | -2917 | -3080 | 180 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 171 | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 181 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 172 | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 182 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 173 | -2423 | -1940 | -5055 | -4683 | -2333 | -4803 | -4471 | 2975 | -4578 | -1136 | 1518 | -4459 | -4558 | -4389 | -4636 | -4122 | -2404 | 2527 | -3893 | -3493 | 183 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 174 | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 184 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 175 | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 185 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 176 | -916 | 1441 | -897 | -330 | -2556 | 783 | -569 | -2253 | 1853 | -2252 | -1375 | -602 | -2001 | -133 | 1844 | 107 | 262 | -1858 | -2453 | -1845 | 186 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 177 | -901 | 1542 | -3045 | -2429 | -736 | -2420 | -1308 | -223 | -2071 | 180 | 2852 | -2011 | -2482 | -1734 | -1947 | 986 | 1407 | 1129 | -1240 | -893 | 187 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 178 | -3284 | -3117 | -3428 | -3438 | 103 | -3920 | 2626 | -3141 | -3196 | -2745 | -2589 | -2856 | -4060 | -2837 | -3158 | 385 | -3295 | -3118 | -600 | 4289 | 188 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 179 | −1202 | −2443 | −944 | -570 | −3032 | 664 | −871 | −2740 | 2635 | −2697 | −1830 | 1016 | −2245 | −445 | −702 | −1120 | 1395 | −2286 | −2850 | −2253 | 189 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 180 | −1363 | −2463 | −834 | −820 | −3504 | 2059 | −1426 | −3279 | −1227 | −3289 | −2438 | 1058 | −2465 | 783 | −1723 | 2215 | −1505 | −2677 | −3478 | −2822 | 190 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 181 | −4791 | −3935 | −4914 | -5231 | −815 | −4530 | −2178 | −4357 | -5024 | −3745 | −3807 | −4206 | −4772 | −4328 | −4584 | −4677 | −4837 | −4435 | −1477 | 4857 | 191 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 182 | −808 | −1661 | −991 | −437 | −1786 | 30 | -599 | 401 | −316 | 453 | −810 | −681 | 795 | 1083 | 743 | 1088 | −748 | −1175 | −1979 | −1446 | 192 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 183 | −2149 | −3976 | 1001 | 3147 | −4176 | −2223 | −1477 | −4059 | −1589 | −3941 | −3204 | 1212 | −2702 | 1224 | −2356 | −1845 | −2188 | −3550 | −4129 | −3181 | 193 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 184 | −4119 | −3542 | -5389 | -5357 | −2027 | −4767 | −4358 | −1609 | -5118 | 3293 | −979 | -5230 | −4771 | −4474 | −4724 | -5069 | −4106 | −2331 | −3412 | −3400 | 194 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 185 | 791 | −889 | −2857 | −2265 | −870 | −2427 | −1358 | −300 | −1960 | 984 | 1413 | −1958 | −2514 | −1671 | −1930 | 1912 | −920 | 849 | −1389 | −1038 | 195 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 186 | −789 | −2013 | 700 | −193 | 230 | −1801 | −476 | −1930 | 1736 | -575 | −1131 | −483 | −1894 | -54 | -588 | 1468 | 605 | −1586 | −2257 | −1636 | 196 |
| — | −149 | -500 | 233 | 43 | −381 | 399 | 106 | −626 | 210 | −466 | −720 | 275 | 394 | 45 | 96 | 359 | 117 | −369 | −294 | −24 | |
| — | −9 | −7942 | −8984 | −894 | −1115 | −701 | −1378 | * | * | | | | | | | | | | | | |
| 187 | 3008 | −1583 | −3739 | −3722 | −3526 | −1951 | −3105 | −2929 | −3498 | −3444 | −2663 | −2536 | −2695 | −3138 | −3395 | 1299 | −1440 | 641 | −3866 | −3649 | 197 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 188 | −4119 | −3542 | -5389 | -5357 | −2027 | −4767 | −4358 | −1609 | -5118 | 3293 | −979 | -5230 | −4771 | −4474 | −4724 | -5069 | −4106 | −2331 | −3412 | −3400 | 198 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 189 | −2820 | −3926 | −976 | 3619 | −4850 | 618 | −2397 | −4922 | −2645 | −4795 | −4203 | −1674 | −3343 | −2134 | −3305 | −2623 | −2989 | −4311 | −4566 | −4055 | 199 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 190 | −1125 | −2274 | −1087 | -569 | −2694 | −2052 | −751 | −2327 | 2735 | −2370 | −1533 | 1515 | −2191 | −333 | -505 | −1066 | 991 | −176 | −2579 | −2023 | 200 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 191 | −3526 | −2989 | -5762 | -5228 | −1135 | -5444 | −4167 | −610 | −4881 | 1755 | 4584 | -5201 | −4703 | −3865 | −4450 | −4828 | −3396 | −1382 | −2878 | −2962 | 201 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 192 | −4720 | −3927 | -5139 | -5454 | 4513 | −4504 | −2520 | −3938 | -5326 | −3307 | −3429 | −4469 | −4782 | −4575 | −4818 | −4787 | −4810 | −4172 | −1812 | −736 | 202 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 193 | −928 | −2343 | 546 | −198 | −2730 | 807 | -590 | −2478 | 1803 | −2438 | −1530 | -505 | −1979 | −145 | −715 | 1580 | 582 | −2025 | −2617 | −1936 | 203 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 194 | −925 | 4101 | −3103 | −2511 | 1370 | −2384 | −1395 | −360 | −2154 | 630 | −81 | −2056 | −2508 | −1816 | −2031 | 323 | 657 | −275 | −1335 | −975 | 204 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 195 | 127 | 1680 | -3023 | -2402 | 2687 | -2398 | -1264 | -237 | -2041 | 380 | 57 | -1982 | -2454 | -1701 | -1912 | 526 | 363 | -156 | -1191 | 957 | 205 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 196 | -1245 | -1254 | -3361 | -2883 | -1574 | 1462 | -2090 | 1383 | -2604 | -1233 | -710 | -2452 | -2897 | -2336 | -2586 | -1814 | 2421 | 1246 | -2175 | -1817 | 206 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 197 | -1433 | -1223 | -3728 | -3105 | 1174 | 1476 | -1882 | 2040 | -2729 | 1166 | 1660 | -2654 | -2998 | -2293 | -2529 | -2122 | -1367 | -384 | -1633 | -1344 | 207 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 198 | -1653 | -2638 | -826 | 2292 | -3549 | 2605 | -1710 | -3115 | -1664 | -3357 | -2623 | -1225 | -2688 | -1395 | -2173 | -1631 | -1817 | 104 | -3654 | -3020 | 208 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -155 | -7942 | -3356 | -894 | -1115 | -701 | -1378 | * | * | | | | | | | | | | | | |
| 199 | -1220 | -2659 | -405 | 1324 | -2791 | -1922 | -742 | -2684 | -410 | -2643 | -1789 | 1187 | -2142 | 2572 | -904 | -1068 | -1177 | -2270 | -2754 | 2625 | 209 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -10 | -7797 | -8839 | -894 | -1115 | -446 | -1911 | * | * | | | | | | | | | | | | |
| 200 | 879 | 3595 | -3205 | -2658 | 2120 | -2294 | -1572 | -547 | -2308 | -945 | -298 | -2123 | -2530 | -1968 | -2185 | 724 | -967 | 819 | -1552 | -1205 | 210 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 201 | 421 | -2123 | -848 | 2201 | -2537 | 1650 | -1017 | -2172 | -778 | 338 | -1534 | -872 | -2260 | -661 | -1248 | -1132 | -1165 | -1846 | -2670 | -2087 | 211 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 202 | -1738 | -2787 | -1885 | -1114 | -3269 | -2574 | -891 | -2832 | 2005 | -206 | -1929 | -1257 | -2607 | -467 | 2218 | 1703 | -1593 | -2517 | -2769 | -2389 | 212 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 203 | -1535 | -3151 | 1411 | 2066 | -3424 | -2046 | 2755 | -3226 | -841 | -3146 | -2290 | 1704 | -2354 | 1290 | -1445 | -1332 | -1516 | -2754 | -3322 | -2532 | 213 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 204 | 443 | -1647 | -3721 | -3895 | -3879 | 3366 | -3333 | -3254 | -3783 | -3812 | -3012 | -2607 | -2739 | -3372 | -3612 | -1325 | -1510 | 267 | -4191 | -4025 | 214 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -1326 | -7942 | -744 | -894 | -1115 | -701 | -1378 | * | * | | | | | | | | | | | | |
| 205 | 2566 | -652 | -1714 | -1730 | -2586 | 1821 | -1677 | -2245 | -1804 | -2543 | -1726 | -1160 | -1601 | -1555 | -1923 | -252 | -423 | -1441 | -2794 | -2521 | 215 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -22 | -6638 | -7680 | -894 | -1115 | -2619 | -256 | * | * | | | | | | | | | | | | |
| 206 | 1348 | 3110 | -1091 | -639 | -1328 | -1184 | -589 | -875 | -410 | -1165 | -443 | -624 | -1546 | 1947 | -698 | -335 | -275 | -590 | -1624 | -1188 | 216 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -22 | -6638 | -7680 | -894 | -1115 | -1813 | -483 | * | * | | | | | | | | | | | | |
| 207 | -723 | -1173 | -1950 | -1826 | -1873 | 2846 | -1634 | -1445 | -1656 | -1624 | 2885 | -1544 | -2151 | -1589 | -1780 | -977 | -982 | -1203 | -2301 | -1916 | 217 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 208 | -1907 | -2634 | -2420 | -1227 | -3433 | -2464 | -430 | -2800 | 2677 | -2483 | -1804 | -1156 | -2426 | -12 | 2828 | -1792 | -1619 | -2560 | -2342 | -2212 | 218 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 209 | -1619 | -3464 | 3298 | 1766 | -3659 | -1517 | -890 | -3594 | -1152 | -3477 | -2831 | -122 | -2058 | -566 | -2007 | -1279 | -1693 | -3079 | -3640 | -2654 | 219 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 210 | -410 | -645 | -1350 | -781 | 1518 | 712 | -465 | -210 | -507 | -476 | 2215 | -818 | -1782 | -427 | 1142 | -719 | -358 | -97 | -1007 | -558 | 220 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 211 | -2334 | -1918 | -4419 | -3864 | -356 | -4133 | -2891 | 223 | -3494 | 2288 | 3708 | -3749 | -3630 | -2761 | -3223 | -3384 | -2226 | -419 | -1952 | -1940 | 221 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 212 | -578 | -1426 | -521 | -599 | -2737 | -1278 | -1129 | -2633 | -1025 | -2740 | -1930 | 2854 | -1845 | -840 | -1420 | 2151 | -840 | -1944 | -2858 | -2267 | 222 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 213 | -2358 | -3091 | -658 | 3674 | -3700 | -2238 | -1776 | -3777 | -1820 | -3720 | -3233 | -1275 | -2731 | -1557 | -2256 | -2198 | -2459 | -3405 | -3352 | -3111 | 223 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 214 | -343 | -723 | -1685 | -1246 | -1235 | -1464 | -999 | 1409 | -1062 | -1029 | -385 | -1095 | -1839 | -923 | -1281 | 1998 | 1407 | -287 | -1662 | -1264 | 224 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 215 | -1879 | -2620 | -2344 | -1198 | -3405 | -2442 | -431 | -2787 | 3092 | -2477 | -1795 | -1139 | -2412 | -13 | 2198 | -1765 | -1600 | -2542 | -2341 | -2201 | 225 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 216 | -2638 | -2256 | -3993 | -3845 | -871 | -3609 | -2933 | -361 | -3459 | 3083 | 119 | -3676 | -3610 | -3057 | -3241 | -3452 | -2638 | -926 | -2214 | -2009 | 226 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 217 | -664 | -1880 | -400 | 14 | -2321 | -1509 | -224 | -1997 | 2156 | -1978 | -1136 | 1625 | -1673 | 197 | 45 | -577 | 1291 | -1607 | -2143 | -1574 | 227 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 218 | -2520 | -3231 | 3969 | -951 | -3894 | -2249 | -1948 | -4204 | -2341 | -4098 | -3667 | -1302 | -2795 | -1775 | -2959 | -2329 | -2670 | -3755 | -3517 | -3297 | 228 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -2432 | -296 | * | * | | | | | | | | | | | | |
| 219 | -2638 | -2256 | -3993 | -3845 | -871 | -3609 | -2933 | -361 | -3459 | 3083 | 119 | -3676 | -3610 | -3057 | -3241 | -3452 | -2638 | -926 | -2214 | -2009 | 229 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -17 | -6952 | -7994 | -894 | -1115 | -864 | -1150 | * | * | | | | | | | | | | | | |
| 220 | -3034 | -2551 | -4364 | -4205 | 143 | -4149 | -1404 | -1231 | -3732 | 2392 | -681 | -3302 | -4000 | -3048 | -3424 | -3428 | -2952 | -1682 | -694 | 3371 | 230 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -11 | -7550 | -8592 | -894 | -1115 | -290 | -2456 | * | * | | | | | | | | | | | | |
| 221 | -1206 | -2579 | -1034 | 1115 | -2976 | -2098 | 1703 | -2665 | 2281 | -2556 | -1677 | 1718 | -2181 | -190 | 1057 | -1081 | -1116 | -2248 | -2655 | -2083 | 231 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 222 | -1402 | -2552 | -831 | -762 | -3458 | 2676 | -1296 | -3209 | 821 | -3189 | -2343 | 1554 | -2453 | -908 | -1386 | 541 | -1498 | -2656 | -3357 | -2721 | 232 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 223 | -1026 | 3123 | -2460 | -2125 | -3296 | 200 | -2099 | -2987 | 668 | -3168 | -2328 | -1859 | -2532 | -1838 | -2112 | 2794 | -1328 | -2309 | -3441 | -3059 | 233 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 224 | -2625 | -4591 | 2620 | 3097 | -4761 | -2375 | -1826 | -4772 | -2227 | -4605 | -4039 | -975 | -2959 | -1521 | -3203 | -2239 | -2725 | -4216 | -4745 | -3684 | 234 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 225 | -4600 | -3560 | -5009 | -5334 | 2635 | -4899 | 2666 | -3516 | -4891 | -2849 | -2927 | -3524 | -4760 | -3655 | -4282 | -4144 | -4455 | -3662 | -365 | 4072 | 235 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 226 | 684 | -1829 | -4834 | -4471 | -2433 | -4365 | -4146 | 1495 | -4328 | -1374 | -1228 | -4141 | -4317 | -4181 | -4382 | -3662 | -2242 | 3236 | -3803 | -3348 | 236 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 227 | -1996 | -1699 | -4301 | -3760 | -1423 | -3788 | -2832 | 1247 | -3457 | 1150 | -374 | -3420 | 2969 | -3065 | -3336 | -2948 | -1952 | 1152 | -2495 | -2229 | 237 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 228 | -1767 | -1840 | -4035 | -3868 | -2376 | -3028 | -3292 | 2122 | -3538 | -1538 | -1371 | -3226 | -3484 | -3384 | -3494 | -2373 | 3280 | -219 | -3364 | -2990 | 238 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 229 | -4791 | -3935 | -4914 | -5231 | -815 | -4530 | -2178 | -4357 | -5024 | -3745 | -3807 | -4206 | -4772 | -4328 | -4584 | -4677 | -4837 | -4435 | -1477 | 4857 | 239 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 230 | -4205 | -4417 | -2343 | 3901 | -5349 | -3698 | -3534 | -5837 | -3838 | -5561 | -5237 | -3039 | -4218 | -3453 | -4201 | -4072 | -4352 | -5409 | -4640 | -4860 | 240 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 231 | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 241 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 232 | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 242 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 233 | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 243 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 234 | -1274 | -1955 | -2502 | -2453 | -3965 | 3211 | -2433 | -3734 | -1975 | -3840 | -2994 | -2099 | -2750 | -2185 | 939 | 699 | -1633 | -2829 | -3940 | -3648 | 244 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 235 | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 245 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 236 | -5598 | -4432 | -5385 | -5722 | -3380 | -4524 | -4140 | -5941 | -5643 | -5318 | -5354 | -5427 | -4938 | -5474 | -5178 | -5909 | -5751 | -5890 | 6275 | -2993 | 246 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 237 | -3870 | -3616 | -4923 | -5074 | -3041 | -4123 | -4208 | -2775 | -4736 | -2183 | 5292 | -4720 | -4529 | -4612 | -4478 | -4340 | -4085 | -3170 | -3793 | -3651 | 247 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 238 | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 248 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 239 | -2440 | -1969 | -5081 | -4773 | -2525 | -4790 | -4760 | 1259 | -4687 | -1315 | -1266 | -4532 | -4623 | -4595 | -4801 | -4162 | -2445 | 3533 | -4180 | -3689 | 249 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 240 | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 250 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 241 | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 251 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 242 | -2838 | -2616 | -4834 | -4880 | -3213 | -3955 | -4416 | -610 | -4757 | -2310 | -2253 | -4383 | -4345 | -4643 | -4642 | -3732 | -3007 | 3763 | -4157 | -3886 | 252 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |

-continued

| | | | | | | | | | | | | | | | | | | | | |
|---|---|---|---|---|---|---|---|---|---|---|---|---|---|---|---|---|---|---|---|---|
| 243 | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 253 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 244 | -5598 | -4432 | -5385 | -5722 | -3380 | -4524 | -4140 | -5941 | -5643 | -5318 | -5354 | -5427 | -4938 | -5474 | -5178 | -5909 | -5751 | -5890 | 6275 | -2993 | 254 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 245 | -2352 | -4269 | 1605 | 3243 | -4435 | -2274 | -1615 | -4361 | -1844 | -4223 | -3552 | -861 | -2805 | 1284 | -2686 | -2008 | -2415 | -3834 | -4412 | -3395 | 255 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 246 | -2968 | -2568 | -5237 | -4809 | -1360 | -4764 | -3887 | 1099 | -4419 | -34 | 4847 | -4576 | -4450 | -3793 | -4171 | -4117 | -2930 | -671 | -2954 | -2840 | 256 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 247 | -4720 | -3927 | -5139 | -5454 | 4513 | -4504 | -2520 | -3938 | -5326 | -3307 | -3429 | -4469 | -4782 | -4575 | -4818 | -4787 | -4810 | -4172 | -1812 | -736 | 257 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 248 | -1307 | -1108 | -3455 | -2868 | -1188 | -2949 | -1880 | 2331 | 358 | -846 | 1520 | -2507 | -2970 | -2242 | -2451 | -2047 | 597 | 2097 | -1808 | -1449 | 258 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 249 | -996 | 2634 | 795 | 2343 | -2711 | -1863 | -676 | -2442 | -336 | -2441 | -1558 | -559 | -2042 | -247 | -853 | 114 | 971 | -2019 | -2654 | -1982 | 259 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 250 | -1030 | -1592 | -3503 | -3413 | -3404 | -1964 | -2934 | -2769 | -3206 | -3298 | -2538 | -2445 | -2684 | -2918 | -3188 | 3064 | 1489 | 582 | -3746 | -3489 | 260 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 251 | -4036 | 5830 | -5292 | -5636 | -5234 | -3985 | -4807 | -5543 | -5599 | -5572 | -5320 | -5040 | -4554 | -5432 | -5141 | -4361 | -4425 | -5051 | -4590 | -5211 | 261 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 252 | -2841 | -3548 | -2782 | -2003 | -4369 | -3246 | -1330 | -3793 | 3622 | -3439 | -2789 | -1967 | -3285 | 1301 | 3 | -2706 | -2569 | -3547 | -3256 | -3128 | 262 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 253 | -3040 | -3587 | -3993 | -2356 | -4556 | -3464 | -1277 | -3807 | 2376 | -3405 | -2766 | -2163 | -3383 | -860 | 3455 | -2914 | -2666 | -3606 | -3193 | -3167 | 263 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 254 | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 264 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 255 | -3051 | -3591 | -3985 | -2369 | -4560 | -3468 | -1291 | -3819 | 1907 | -3417 | -2780 | -2175 | -3392 | -876 | 3661 | -2926 | -2679 | -3617 | -3203 | -3178 | 265 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 256 | -3202 | -2787 | -5004 | -4996 | -2836 | -4384 | -4440 | 3937 | -4838 | -1815 | -1871 | -4704 | -4600 | -4683 | -4704 | -4353 | -3280 | -603 | -3938 | -3661 | 266 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 257 | -2529 | -2315 | -4845 | -4518 | -1580 | -4064 | -3663 | -283 | -4108 | -355 | 4839 | -4078 | -4123 | -3684 | -3934 | -3416 | -2594 | 956 | -3026 | -2805 | 267 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |
| 258 | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 268 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -9 | -7942 | -8984 | -894 | -1115 | -701 | -1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 259 | −1329 | −2035 | −2429 | −2244 | −3895 | 2854 | −2166 | −3627 | −1525 | −3684 | −2851 | −1989 | −2743 | −1869 | 2143 | 670 | −1640 | −2809 | −3768 | −3462 | 269 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 260 | 333 | 2173 | −1976 | −1501 | −2712 | −1910 | −1559 | −2364 | 756 | −2555 | −1742 | −1465 | −2354 | −1261 | −1690 | 2683 | 445 | −1889 | −2895 | −2438 | 270 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 261 | −2629 | −4603 | 2982 | 2824 | −4769 | −2374 | −1827 | −4781 | −2233 | −4613 | −4050 | −973 | −2960 | −1523 | −3215 | −2241 | −2729 | −4224 | −4756 | −3689 | 271 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 262 | 3227 | −1598 | −3808 | −3853 | −3675 | −1943 | −3208 | −3121 | −3627 | −3612 | −2811 | −2572 | −2704 | −3246 | −3487 | 659 | −1456 | 120 | −3999 | −3805 | 272 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 263 | −1678 | −2306 | −2163 | −1368 | −2580 | −2636 | −1002 | 2355 | 2343 | −2186 | −1484 | −1443 | −2669 | −654 | 876 | −1735 | 641 | −1817 | −2475 | −2127 | 273 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 264 | −4088 | −3924 | −4774 | -5139 | -5615 | 3825 | −4753 | −6303 | -5453 | −6014 | -5662 | −4812 | −4539 | -5232 | -5106 | −4370 | −4472 | -5527 | −4696 | -5561 | 274 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 265 | −3686 | −3083 | -5691 | -5304 | 2479 | -5415 | −3206 | −817 | -5030 | 2801 | −119 | −4892 | −4733 | −3869 | −4522 | −4791 | −3543 | −1610 | −2174 | −1529 | 275 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 266 | 1903 | −2297 | 702 | −1544 | −4168 | 2837 | −2339 | −3984 | −2585 | −4104 | −3288 | −1618 | −2762 | −2091 | −3086 | −1567 | −1822 | −3080 | −4284 | −3742 | 276 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −403 | −7942 | −2060 | −894 | −1115 | −701 | −1378 | * | * | | | | | | | | | | | | |
| 267 | 834 | 3930 | −2831 | −2402 | −1432 | −1861 | −1668 | −863 | −2105 | 526 | −631 | −1870 | 1986 | −1849 | −2106 | −1085 | −873 | −679 | −1916 | −1576 | 277 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −11 | −7550 | −8592 | −894 | −1115 | −290 | −2456 | * | * | | | | | | | | | | | | |
| 268 | 1108 | −1096 | −2107 | −1546 | −1182 | 1531 | −1149 | −706 | −1287 | 1092 | −370 | −1499 | −2344 | −1160 | 691 | −1261 | −890 | 408 | −1610 | −1222 | 278 |
| — | −149 | -500 | 233 | 43 | −381 | 399 | 106 | −626 | 210 | −466 | −720 | 275 | 394 | 45 | 96 | 359 | 117 | −369 | −294 | −249 | |
| — | −9 | −7942 | −8984 | −894 | −1115 | −701 | −1378 | * | * | | | | | | | | | | | | |
| 269 | 447 | −1594 | −1489 | −1022 | −2056 | −171 | −1111 | −1648 | −921 | −1888 | −1129 | −1139 | 1521 | 2213 | −1300 | −1044 | −979 | 1814 | −2309 | −1831 | 279 |
| — | * | * | * | * | * | * | * | * | * | * | * | * | * | * | * | * | * | * | * | * | |
| — | * | * | * | * | * | * | * | * | 0 | | | | | | | | | | | | |
| // | | | | | | | | | | | | | | | | | | | | | |

| | |
|---|---|
| HMMER2.0 | [2.3.2] |
| NAME | Auxin_resp |
| ACC | PF06507.5 |
| DESC | Auxin response factor |
| LENG | 84 |
| ALPH | Amino |
| RF | no |
| CS | no |
| MAP | yes |
| COM | hmmbuild -F HMM_ls.ann SEED.ann |
| COM | hmmcalibrate --seed 0 HMM_ls.ann |
| NSEQ | 17 |
| DATE | Tue Apr 22 21:04:11 2008 |
| CKSUM | 5386 |
| GA | 25.0000 25.0000; |
| TC | 26.0000 25.7000; |
| NC | 22.6000 22.6000; |
| XT | −8455 −4 −1000 −1000 −8455 −4 −8455 −4 |
| NULT | −4 −8455 |
| NULE | 595 −1558 85 338 −294 453 −1158 197 249 902 −1085 −141 −21 −313 45 531 201 384 −1998 −644 |
| EVD | −75.925690 0.233690 |

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | −126 | * | −3584 | | | | | | | | | | | | | | | | | | |
| 1 | 3158 | −2363 | −4879 | −5046 | −4109 | −2910 | −4298 | −2021 | −4794 | −3510 | −3120 | −3604 | −3648 | −4394 | −4552 | −2284 | −2337 | 1877 | −4810 | −4582 | 1 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | −126 | * | | | | | | | | | | | | |
| 2 | 2404 | −1457 | −2392 | −1812 | −1455 | −2644 | −1427 | 389 | −180 | −1328 | −649 | −1813 | −2713 | −1438 | −25 | −223 | −1240 | 50 | 3011 | −1486 | 2 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 3 | −1601 | −2389 | −1668 | −1348 | −2708 | −2543 | 4340 | −2420 | −1284 | −169 | −1835 | 1780 | −2798 | −1256 | −1658 | −276 | −53 | −2135 | −2918 | −2372 | 3 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 4 | 2915 | −2554 | 707 | −1372 | −2968 | −2600 | −1658 | −2581 | −1354 | −64 | −2011 | −1576 | −2882 | −1337 | 414 | −1767 | −1763 | −2295 | −3143 | −2616 | 4 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 5 | 1682 | −1177 | −3545 | −2918 | 345 | −2865 | −1732 | 1439 | −2543 | −239 | −380 | −154 | −2916 | −2192 | −2391 | −379 | 692 | 1423 | −1637 | −1292 | 5 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 6 | 1460 | −2603 | 76 | −485 | −2909 | −2150 | −811 | −532 | 339 | −2613 | −1698 | −792 | −2243 | 677 | 303 | 1897 | 76 | −2217 | −2797 | −2125 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 7 | −1401 | −2399 | −1584 | −1137 | −2996 | −2361 | −1401 | −2671 | −1077 | −2779 | −1940 | 1426 | −2613 | 803 | −1526 | 1478 | 2614 | −128 | −3069 | −2498 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 8 | 241 | −2662 | −1052 | −502 | −2986 | 1687 | 1227 | −2730 | 1693 | −2675 | −1753 | 974 | −2264 | 612 | 165 | −1083 | 119 | −2286 | −2840 | −2166 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 9 | −1285 | 2015 | −1615 | −1058 | −2188 | −2393 | −1153 | −1798 | −880 | −428 | −1241 | −1264 | −2506 | 1518 | 69 | 1848 | 1819 | −1576 | −2414 | −1913 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 10 | −1452 | 1402 | −3760 | −3145 | −1285 | −2998 | −1931 | 1785 | −2762 | −1120 | 2902 | −2654 | 2375 | −2402 | −2590 | −443 | −1406 | 478 | −1814 | −1469 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 11 | −5765 | −4802 | −5973 | −6324 | 4566 | −5247 | −3479 | −5215 | −6252 | −4532 | −4649 | −5413 | −5556 | −5531 | −5699 | −5820 | −5855 | −5401 | −2775 | −1729 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 12 | −1184 | −2349 | −1170 | 1209 | −2557 | −2212 | 2089 | 403 | −525 | −948 | −1470 | 267 | −2302 | −474 | 673 | 569 | 1440 | −280 | −2605 | −1999 | 12 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 13 | −3033 | −2524 | −5724 | −5423 | −3214 | −5548 | −5661 | 2319 | −5397 | −1959 | −1903 | −5236 | −5303 | −5366 | −5577 | −4943 | −3030 | 3306 | −5003 | −4468 | 13 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 14 | −246 | −1216 | −3577 | −2962 | 2607 | −2872 | −1758 | −716 | −2587 | −1078 | −434 | −2496 | −2942 | −2233 | −2434 | −200 | 583 | 1556 | −1654 | 2395 | 14 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 15 | −5286 | −4226 | −5668 | −6022 | 1003 | −5533 | −1778 | −4182 | −5588 | −3489 | −3587 | −4191 | −5409 | −4330 | −4959 | −4817 | −5149 | −4346 | −1026 | 4765 | 15 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 16 | −1301 | 1855 | −1228 | −680 | −2768 | −2288 | 1051 | −2516 | 2062 | −2542 | −1679 | 2145 | −2382 | −512 | −934 | 70 | −1238 | −2156 | −2744 | 1860 | 16 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 17 | −5672 | −5016 | −5908 | −6280 | −6507 | −5021 | −5699 | −7438 | −6489 | −6950 | −6782 | −6096 | 4323 | −6350 | −6037 | −6019 | −5995 | −6875 | −5439 | −6461 | 17 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 18 | −2727 | −3554 | −3162 | −2163 | −4157 | −3465 | −1607 | −3633 | 705 | −3463 | −2737 | −2184 | −3465 | −1194 | 3552 | −511 | 202 | −3369 | 2570 | −3202 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 19 | 2153 | −1573 | −2221 | −1661 | −1630 | −2573 | −1421 | 176 | −1488 | −289 | −803 | −1712 | −2681 | 940 | −1758 | 313 | 1560 | −1048 | −2030 | −1618 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −324 | −8606 | −2330 | −894 | −1115 | −701 | −1378 | * | * | | | | | | | | | | | | |
| 20 | 143 | 1765 | −4338 | −4388 | −4343 | 1503 | −3673 | −4106 | −4108 | −4368 | −3452 | −2932 | −3014 | −3687 | −3938 | 2844 | 719 | −3003 | −4586 | −4460 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8289 | −9331 | −894 | −1115 | −2001 | −415 | * | * | | | | | | | | | | | | |
| 21 | −1173 | −2357 | −1154 | −580 | −2602 | −2164 | 1564 | −2283 | −268 | −2323 | −1478 | −848 | 1740 | 1593 | 537 | −1106 | 1579 | −1948 | 3058 | −1972 | 21 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8289 | −9331 | −894 | −1115 | −245 | −2679 | * | * | | | | | | | | | | | | |
| 22 | 1767 | −2279 | −4528 | −4787 | −4908 | −2548 | −4144 | −4721 | −4673 | −4976 | −4021 | −3277 | 20 | −4180 | −4427 | 3129 | −2134 | −3455 | −5124 | −5050 | 22 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 23 | −2603 | −4389 | 1294 | 2902 | −4604 | −2756 | −1964 | −4471 | −2021 | −4361 | −3595 | 640 | −44 | 2208 | −2756 | −2318 | −2630 | −3969 | −4546 | −3630 | 23 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 24 | −5765 | −4802 | −5973 | −6324 | 4566 | −5247 | −3479 | −5215 | −6252 | −4532 | −4649 | −5413 | −5556 | −5531 | −5699 | −5820 | −5855 | −5401 | −2775 | −1729 | 24 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 25 | −2983 | 1350 | −5676 | −5358 | −3204 | −5464 | −5493 | 2754 | −5317 | −1987 | −1903 | −5149 | −5241 | −5276 | −5479 | −4833 | −2980 | 2948 | −4915 | −4383 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | −3034 | −2523 | −5726 | −5424 | −3216 | −5558 | −5670 | 2911 | −5401 | −1960 | −1903 | −5240 | −5307 | −5371 | −5582 | −4952 | −3030 | 2939 | −5010 | −4474 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 27 | −1551 | −2924 | −1428 | −851 | −3317 | −389 | −1043 | −3016 | 1430 | −2926 | −2039 | −1121 | 2513 | 658 | 847 | 1213 | −1471 | −2594 | −3045 | −2454 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 28 | 1326 | −1201 | −3604 | −2977 | 475 | −2898 | −1749 | −677 | −2591 | 989 | −390 | −2508 | −2947 | −2232 | 482 | −1979 | −1302 | 1261 | −1631 | 2428 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 29 | 1034 | −2632 | 1184 | 1570 | −2942 | −2154 | −820 | −2685 | −408 | −1035 | −1726 | 1515 | 21 | −365 | −915 | −92 | −1124 | −2248 | 1726 | −2145 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 30 | −1366 | −2829 | 955 | 674 | −3163 | −2282 | −944 | −2904 | 2774 | −2835 | −1923 | −915 | −2394 | 685 | 906 | −198 | −1302 | −2460 | −2987 | −2321 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 31 | −573 | −2764 | −4904 | −4634 | 2430 | −4358 | −1850 | −2102 | −4237 | −2323 | −1974 | −3629 | −4367 | −3558 | −3920 | −3513 | −3056 | 1569 | −1225 | 3804 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 32 | −1255 | −1621 | −1953 | 1029 | −1645 | −2511 | −1259 | 878 | −1237 | 926 | 2458 | 129 | −2584 | 338 | 651 | −1493 | −31 | −56 | −2015 | −1582 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 33 | 865 | −2660 | 708 | 1533 | −2981 | 65 | −816 | −2731 | 1814 | −2676 | −1750 | −787 | −2250 | −358 | 381 | −1066 | 273 | −2282 | −2843 | −2160 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 34 | 2828 | −2243 | −4729 | −4922 | −4653 | −2554 | −4101 | −4218 | −4649 | −4651 | −3779 | −3304 | −3349 | −4174 | −4381 | 2220 | −2112 | −2 | −4935 | −4824 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −135 | −8606 | −3522 | −894 | −1115 | −701 | −1378 | * | * | | | | | | | | | | | | |
| 35 | −1408 | −1222 | −3717 | −3095 | 696 | −2986 | −1873 | 1608 | −233 | −980 | 3641 | −2615 | −3024 | −2347 | −2535 | −2076 | 93 | 1469 | −1741 | −1398 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8477 | −9519 | −894 | −1115 | −1410 | −681 | * | * | | | | | | | | | | | | |
| 36 | 102 | 1006 | 380 | −411 | 10 | −2070 | −732 | −2514 | 1033 | −2494 | −1587 | 1007 | −2163 | −281 | 1431 | 649 | 159 | −2097 | −2691 | 1181 | 36 |
| — | −149 | −500 | 233 | 43 | −381 | 399 | 109 | −626 | 210 | −466 | −720 | 275 | 394 | 45 | 96 | 359 | 117 | −369 | −294 | −249 | |
| — | −167 | −3215 | −9519 | −152 | −3318 | −387 | −2087 | * | * | | | | | | | | | | | | |
| 37 | −264 | −2169 | −1297 | −745 | −2320 | −2266 | 1108 | 1075 | −643 | −2111 | 829 | 1746 | 438 | 1339 | −1102 | 543 | 62 | −1698 | −2465 | 609 | 38 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 38 | −1263 | −2695 | −1119 | −566 | 270 | −407 | −865 | −2754 | 1286 | −2701 | −1789 | 999 | 2184 | 1942 | 281 | −1147 | −1198 | −2321 | −2865 | −2209 | 39 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 39 | −1466 | −1285 | −3789 | −3165 | 2448 | −3007 | −1797 | 332 | −2762 | 960 | −442 | −2636 | −226 | −2369 | −2558 | −2095 | −1406 | 914 | 3293 | 1447 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 40 | 454 | 3590 | −4308 | −4068 | −3051 | −2608 | −3173 | 711 | −3750 | −2951 | −2248 | −3040 | −3239 | −3383 | −3618 | 2601 | 393 | −2151 | −3486 | −3199 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 41 | −1871 | −1643 | −4219 | −3641 | −1738 | −3543 | −2538 | 1710 | −3294 | 308 | −873 | −3191 | 1329 | −2961 | −3153 | 237 | −1829 | 2506 | −2393 | −2038 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 42 | −5249 | −4846 | −5805 | −6182 | −6521 | 3848 | −5650 | −7348 | −6455 | −6931 | −6666 | −5891 | −5413 | −6249 | −6011 | −5566 | −5614 | −6629 | −5452 | −6497 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 43 | −1676 | −2204 | −4295 | −4313 | −3842 | −2610 | −3630 | −3414 | −3990 | −3691 | 4490 | −3163 | −3338 | −3713 | −3859 | 545 | 2236 | −2819 | −4249 | −3995 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 44 | −5677 | −5058 | −5817 | −5522 | −6223 | −5022 | −4626 | −6808 | −3755 | −6307 | −5975 | −5374 | −5388 | −4598 | 4244 | −5871 | −5687 | −6494 | −5162 | −5792 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 45 | −3849 | −3458 | −5602 | −5638 | 4188 | −4959 | −2644 | −1797 | −5340 | −2003 | −2115 | −4492 | −5045 | −4488 | −4945 | −4379 | −3914 | 1287 | −1909 | −813 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 46 | −452 | −3393 | −2564 | −1776 | −4088 | −601 | −1504 | −3633 | 2769 | −3449 | −2660 | −1888 | −3210 | −1074 | 2654 | −2258 | −187 | −3269 | −3443 | −3096 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 47 | −313 | −3137 | −5778 | −5307 | −1776 | −4999 | −4282 | −1158 | −4931 | 1098 | 4789 | −4957 | −4805 | −4165 | −4607 | −4292 | −3407 | −1758 | −3365 | −3386 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 48 | 933 | −1482 | −2775 | −2167 | −1424 | −2820 | −1593 | 121 | −1766 | 586 | 1828 | −2079 | −2872 | 195 | 2706 | −1860 | −1364 | −887 | −1901 | −1536 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 49 | −3620 | −3153 | −5277 | −5067 | 3926 | −4844 | −2036 | −2178 | −4669 | −1773 | 2622 | −3982 | −4721 | −3836 | −4280 | −4014 | −3532 | 42 | −1344 | 1353 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 50 | −3327 | −5016 | −989 | 3683 | −5391 | −3101 | −2592 | −5490 | −2924 | −5315 | −4768 | 1054 | −3690 | −2301 | −3760 | −2981 | −3450 | −4913 | −5309 | −4385 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 51 | −1579 | −2188 | −3546 | −3267 | −3804 | 2080 | −3055 | −3476 | −3125 | −3725 | 1432 | −2722 | 776 | −2913 | −3295 | 869 | 2548 | −2812 | −4071 | −3748 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 52 | −3136 | −5164 | 2005 | 3364 | −5294 | −2912 | −2331 | −5270 | −211 | −5101 | −4513 | −1495 | −3488 | −2017 | −3605 | −2749 | −3226 | −4718 | −5291 | −4195 | 53 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 53 | −3331 | −5323 | 3517 | 2295 | −5495 | −3020 | −2505 | −5542 | −2968 | −5354 | −4832 | −1623 | −3620 | −2209 | −4000 | −2928 | −3443 | −4971 | −5469 | −4396 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 54 | 2071 | 1447 | −4593 | −4549 | 1139 | −2572 | −3620 | −3400 | −4226 | −3727 | −2962 | −3194 | −3299 | −3802 | −4024 | 2692 | −2016 | −2769 | −4084 | −3785 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 55 | −1734 | −2436 | −3189 | −3067 | −4553 | 478 | −3071 | −4316 | −2778 | −4439 | −3546 | −2669 | 2412 | −2815 | 751 | 2669 | −2103 | −3345 | −4583 | −4272 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 56 | −2424 | −3531 | −2382 | 2744 | −4085 | −3177 | −1466 | −3622 | 1040 | −3435 | −2653 | −1829 | −3217 | −1035 | 2208 | −2301 | −2261 | 397 | −3431 | −3069 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2104 | −8606 | −387 | −894 | −1115 | −701 | −1378 | * | * | | | | | | | | | | | | |
| 57 | −1459 | −1175 | −3249 | −3035 | −1029 | −2949 | −2488 | 3389 | −2728 | −54 | −62 | −2796 | −3066 | −2610 | −2714 | −2453 | −1501 | 936 | −2199 | −1781 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −23 | −6526 | −7568 | −894 | −1115 | −86 | −4112 | * | * | | | | | | | | | | | | |
| 58 | −2606 | −3632 | −2809 | −1920 | −4277 | −3345 | −1519 | −3767 | 1117 | −3527 | −2764 | −2006 | −3348 | 639 | 3424 | 340 | 202 | −3449 | −3475 | −3184 | 59 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 59 | −2336 | −2643 | −3496 | −2604 | −2448 | −3337 | −1801 | 4 | −946 | −2595 | −1970 | −2455 | −3448 | −1637 | 3429 | 241 | −2269 | −2298 | 3457 | −2140 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 60 | −1706 | 1723 | −3011 | −2447 | 2711 | −3057 | −1572 | −1297 | −2126 | −1576 | −946 | −2292 | −3116 | 934 | 165 | −182 | −1647 | −1201 | −1578 | 3104 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 61 | 23 | −2178 | −21 | −746 | −73 | −2267 | −957 | −1978 | −646 | −2125 | 2814 | −1009 | 1121 | 814 | −1106 | 467 | 1568 | −1711 | −2477 | −1914 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 62 | −3434 | −3779 | −4840 | −5207 | −5953 | 3677 | −4997 | −6231 | −5599 | −6197 | −5534 | −4559 | 890 | −5230 | −5366 | −3681 | −3876 | −5136 | −5373 | −5949 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 63 | −2791 | −2402 | −5433 | −5090 | −3009 | −4898 | −4792 | 1931 | −4946 | −1920 | −1793 | −4731 | −4881 | −4800 | −4995 | −4211 | 3152 | 1607 | −4423 | −3972 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 64 | −2899 | −2434 | −5494 | −5124 | −2757 | −5193 | −4582 | 3125 | −4986 | −1836 | −1726 | −4827 | −5006 | −4806 | −5024 | −4489 | −2883 | 2404 | −4077 | 1257 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 65 | −1381 | −1235 | −3615 | −2999 | 693 | 77 | −1823 | 1697 | −2627 | −1093 | −458 | −2538 | −2977 | −2277 | −2476 | 862 | 1302 | 1818 | −1730 | −1384 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 66 | −142 | −2219 | −3922 | −3850 | −4111 | 3247 | −3489 | −3829 | −3755 | −4094 | −3260 | −2980 | −3266 | −3443 | −3782 | −181 | 723 | −3027 | −4398 | 996 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 67 | −2416 | −2139 | −4955 | −4522 | −2616 | −4236 | −3775 | 2429 | −4277 | −1855 | −1561 | −4064 | −4324 | −4030 | −4223 | 528 | 203 | 2736 | −3591 | −3191 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 68 | −1170 | 1424 | −1019 | 331 | −2953 | −412 | −802 | −2701 | 402 | −2649 | −1724 | 1365 | −2237 | 1255 | 1256 | 1452 | −1108 | −2255 | −2819 | 648 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 69 | −2806 | −4638 | 3415 | 1491 | −4825 | −2822 | −2115 | −4703 | −2278 | −4602 | −3895 | −1414 | −3323 | 808 | −3073 | −2491 | −2856 | 412 | −4803 | −3836 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −104 | −8606 | −3898 | −894 | −1115 | −701 | −1378 | * | * | | | | | | | | | | | | |
| 70 | 581 | 1447 | −3544 | −2911 | 423 | −2794 | −1663 | −580 | −2519 | 1651 | 1200 | 81 | −2845 | −2152 | −2338 | 389 | −1193 | 769 | −1544 | 667 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8508 | −9550 | −894 | −1115 | −432 | −1951 | * | * | | | | | | | | | | | | |
| 71 | −2326 | −4006 | 3154 | 502 | −4259 | −2668 | 1821 | −4084 | 79 | −3992 | −3175 | −1269 | −3045 | −1366 | −2311 | 1350 | −2326 | −3603 | −4170 | −3332 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 72 | −1642 | 2346 | −4813 | −5021 | −4767 | −2542 | −4146 | −4541 | −4699 | −4816 | −3888 | −3316 | 3597 | −4217 | −4410 | 1250 | 418 | −3368 | −5013 | −4933 | 73 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −616 | −8606 | −1535 | −894 | −1115 | −701 | −1378 | * | * | | | | | | | | | | | | |
| 73 | −907 | −784 | −2948 | −2331 | −743 | 146 | −1274 | 1385 | −1991 | 144 | 1577 | 314 | −2472 | −1670 | −1898 | 64 | 508 | 1186 | −1236 | 1326 | 74 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −7998 | −9041 | −894 | −1115 | −489 | −1798 | * | * | | | | | | | | | | | | |
| 74 | −1534 | −2489 | −1675 | −1047 | −2713 | −2535 | 2456 | −2330 | −436 | −2415 | 1231 | −1262 | 285 | 766 | 2938 | −1516 | −1445 | −205 | −2684 | −2192 | 75 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8477 | −9519 | −894 | −1115 | −1410 | −681 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 75 | −6425 | −5097 | −6048 | −6410 | −4432 | −5141 | −5003 | −6948 | −6438 | −6277 | −6316 | −6204 | −5561 | −6262 | −5919 | −6797 | −6574 | −6838 | 6295 | −4062 | 76 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8477 | −9519 | −894 | −1115 | −1410 | −681 | * | * | | | | | | | | | | | | |
| 76 | −3091 | −3857 | −3522 | −2373 | −4664 | −3649 | 2349 | −4023 | 1940 | −3689 | −3003 | −2317 | 3196 | −1184 | 1030 | −2963 | −2799 | −3775 | −3544 | −3406 | 77 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8477 | −9519 | −894 | −1115 | −387 | −2087 | * | * | | | | | | | | | | | | |
| 77 | −127 | 967 | 1232 | −506 | −2991 | 1303 | −849 | −2737 | 402 | −2690 | −1771 | 2327 | −2277 | −393 | 701 | −1098 | −1157 | −2294 | −2863 | −2185 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 78 | −2873 | −3334 | −4781 | −5130 | −5373 | −3522 | −4723 | −5714 | −5297 | −5786 | −5056 | −4198 | −4255 | −4941 | −5056 | 3723 | −3329 | −4590 | −5178 | −5309 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 79 | −1800 | −3196 | −1381 | 1717 | −3585 | −2608 | 1114 | −3282 | 2656 | −3170 | −2302 | −1240 | 1388 | 525 | −887 | −1660 | −1718 | −2862 | −3271 | −2682 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 80 | −6613 | −5251 | −6201 | −6567 | −4682 | −5286 | −5202 | −7171 | −6615 | −6493 | −6531 | −6381 | −5707 | −6440 | −6087 | −7000 | −6761 | −7049 | 6298 | −4318 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 81 | −3576 | −4162 | −4201 | −2830 | −5136 | −3986 | −1828 | −4377 | 751 | −3973 | −3333 | 545 | −3925 | −1411 | 3869 | −3440 | −3212 | −4170 | −3770 | −3729 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 82 | −1403 | 3478 | −3083 | −2545 | −1621 | −2718 | −1874 | −1162 | −2277 | 174 | 1752 | 1360 | −2928 | −2052 | −2344 | 2075 | −1427 | −1041 | −2091 | −1724 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 83 | −4196 | −3597 | −6531 | −5970 | 817 | −6277 | −4734 | −1153 | −5752 | 3096 | −503 | −5959 | −5364 | −4517 | −5228 | −5635 | −4041 | −59 | −3378 | −3348 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 84 | −1444 | −2812 | −1345 | 1389 | −3158 | −2393 | −972 | −2859 | 1653 | 130 | −1909 | −1037 | −2472 | 2515 | 574 | −1332 | −1365 | −261 | −2944 | −2339 | 85 |
| — | * | * | * | * | * | * | * | * | * | * | * | * | * | * | * | * | * | * | * | * | |
| — | * | * | * | * | * | * | * | * | 0 | | | | | | | | | | | | |
| // | | | | | | | | | | | | | | | | | | | | | |

HMMER2.0 [2.3.2]
NAME B3
ACC PF02362.13
DESC B3 DNA binding domain
LENG 104
ALPH Amino
RF no
CS yes
MAP yes
COM hmmbuild -F HMM__ls.ann SEED.ann
COM hmmcalibrate --seed 0 HMM__ls.ann
NSEQ 160
DATE Wed Apr 23 15:07:36 2008
CKSUM 643
GA 26.5000 26.5000;
TC 26.9000 26.7000;
NC 26.3000 26.3000;
XT −8455 −4 −1000 −1000 −8455 −4 −8455 −4
NULT −4 −8455
NULE 595 −1558 85 338 −294 453 −1158 197 249 902 −1085 −142 −21 −313 45 531 201 384 −1998 −644
EVD −43.962971 0.265053

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | −14 | * | −6727 | | | | | | | | | | | | | | | | | | |
| 1 | −2155 | 2065 | −1645 | −916 | 2112 | −2620 | 960 | −224 | −282 | 151 | 277 | −2530 | −602 | 131 | −839 | 625 | −355 | −1870 | 391 | 1591 | 1 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11881 | −12923 | −894 | −1115 | −701 | −1378 | −14 | * | | | | | | | | | | | | |
| 2 | −1692 | 369 | −6521 | −5885 | 3718 | −2463 | −4603 | −694 | −2672 | 684 | −888 | −961 | −1404 | −2004 | −2662 | −941 | −2575 | 14 | −4471 | −543 | 2 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11881 | −12923 | −894 | −1115 | −701 | −1378 | * | * | | | | | | | | | | | | |
| 3 | −1038 | 622 | −562 | 450 | 1832 | −4926 | −652 | −2103 | −189 | −735 | −656 | −2042 | −5017 | 779 | −459 | −465 | 1499 | 1474 | −5423 | −4791 | 3 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −36 | −11881 | −5350 | −894 | −1115 | −701 | −1378 | * | * | | | | | | | | | | | | |
| 4 | 629 | −4402 | −4705 | −2860 | −738 | −818 | −453 | −709 | 2645 | 421 | −623 | −4267 | −5350 | 852 | −230 | −563 | −2301 | −226 | −4795 | −2004 | 4 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11845 | −12887 | −894 | −1115 | −1473 | −645 | * | * | | | | | | | | | | | | |
| 5 | −897 | 102 | −1215 | 14 | −2296 | −1948 | 584 | 722 | −190 | −1636 | 786 | −214 | 349 | −91 | −403 | −145 | 1791 | 1031 | −5497 | −4826 | 5 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11853 | −12895 | −894 | −1115 | −1028 | −972 | * | * | | | | | | | | | | | | |
| 6 | −2460 | −3997 | −1924 | −5879 | 1158 | −2743 | −4589 | 1184 | −2512 | 1994 | 1897 | −5364 | −2486 | −5097 | −5274 | −1675 | −1066 | 1534 | −4454 | −1036 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −11864 | −7604 | −894 | −1115 | −1568 | −593 | * | * | | | | | | | | | | | | |
| 7 | −1681 | −1513 | −6322 | −5698 | −689 | −5683 | −4545 | −70 | 789 | 455 | −65 | 219 | −2859 | −2569 | 99 | 641 | 2569 | −391 | −979 | −4119 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11857 | −12899 | −894 | −1115 | −1825 | −479 | * | * | | | | | | | | | | | | |
| 8 | 777 | 388 | −1216 | −1603 | −586 | −1180 | 1192 | −2993 | −5 | −3211 | −4431 | −372 | 2645 | 138 | 2 | 287 | −793 | −382 | −5526 | −2042 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −39 | −11857 | −5257 | −894 | −1115 | −1825 | −479 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 9 | −2008 | −1444 | 6 | 241 | −2587 | 215 | −176 | −5169 | −3117 | −2550 | −1268 | 440 | −4940 | −1539 | −2362 | 2775 | −1126 | −813 | −863 | 779 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −47 | −11819 | −4970 | −894 | −1115 | −1787 | −494 | * | * | | | | | | | | | | | | |
| 10 | −2568 | −231 | 2498 | −1439 | 959 | −2468 | 1609 | −5313 | −3028 | −5270 | −127 | 1378 | −2391 | −904 | −659 | 1262 | −1363 | −686 | −5447 | 298 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1 | −11784 | −12826 | −894 | −1115 | −982 | −1019 | * | * | | | | | | | | | | | | |
| 11 | 72 | −943 | −1952 | −1154 | 824 | −1822 | 725 | 115 | 0 | 1494 | −487 | −5164 | −5686 | −1580 | −1916 | −4702 | −82 | 1876 | −4459 | −1287 | 11 |
| — | −146 | −500 | 232 | 43 | −381 | 401 | 105 | −627 | 210 | −466 | −721 | 277 | 393 | 45 | 95 | 359 | 117 | −370 | −295 | −250 | |
| H | −39 | −6925 | −5779 | −2168 | −363 | −2467 | −288 | * | * | | | | | | | | | | | | |
| 12 | −2666 | −5297 | −17 | −515 | −5617 | 1046 | 81 | −749 | 542 | −824 | 609 | 287 | −1821 | 72 | 730 | 1417 | 206 | −1562 | −5480 | 216 | 17 |
| — | −149 | −500 | 233 | 45 | −381 | 399 | 106 | −626 | 210 | −466 | −720 | 275 | 394 | 45 | 96 | 359 | 117 | −369 | −294 | −249 | |
| H | −47 | −6791 | −5447 | −176 | −3122 | −2919 | −205 | * | * | | | | | | | | | | | | |
| 13 | −1526 | −771 | −688 | −1746 | −519 | −1346 | 1256 | −549 | 1379 | −2366 | −4354 | 1081 | −1462 | 364 | 1111 | 1042 | 744 | −2878 | −5448 | 886 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −81 | −11772 | −4195 | −894 | −1115 | −2461 | −289 | * | * | | | | | | | | | | | | |
| 14 | −2430 | 2241 | 1611 | −320 | −1647 | 1099 | 525 | −699 | −138 | 1226 | 83 | −411 | −2606 | −1709 | −366 | −694 | −3671 | −4780 | −5360 | −532 | 20 |
| — | −149 | −500 | 233 | 43 | −381 | 398 | 105 | −626 | 210 | −466 | −721 | 275 | 394 | 48 | 96 | 360 | 117 | −369 | −295 | −250 | |
| T | −14 | −6688 | −12745 | −984 | −1016 | −2589 | −262 | * | * | | | | | | | | | | | | |
| 15 | −511 | 547 | −573 | −1265 | 859 | 814 | −851 | −258 | 335 | −1264 | 1464 | 1304 | −4822 | 251 | 1664 | −1562 | 226 | −2947 | −5386 | −4711 | 23 |
| — | −149 | −500 | 233 | 43 | −381 | 399 | 106 | −626 | 210 | −466 | −720 | 275 | 394 | 45 | 96 | 359 | 117 | −369 | −294 | −245 | |
| — | −38 | −6964 | −5811 | −203 | −2929 | −3011 | −191 | * | * | | | | | | | | | | | | |
| 16 | −2342 | −3850 | −6340 | −1896 | −1124 | −330 | −4434 | 1319 | −5306 | 1921 | 1943 | −3166 | −2382 | −1049 | 1789 | −4648 | −1829 | −480 | 894 | −3964 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −233 | −11708 | −2749 | −894 | −1115 | −693 | −1390 | * | * | | | | | | | | | | | | |
| 17 | −3904 | 187 | −1761 | −2511 | 1381 | −1814 | −351 | 893 | −2307 | 687 | 1860 | −4928 | −541 | −2516 | 787 | −338 | −316 | −389 | −4245 | 2377 | 26 |
| — | −149 | −500 | 233 | 43 | −381 | 398 | 105 | −624 | 210 | −466 | −714 | 275 | 394 | 45 | 96 | 360 | 117 | −370 | −295 | −250 | |
| E | −63 | −6932 | −4849 | −1479 | −641 | −3542 | −130 | * | * | | | | | | | | | | | | |
| 18 | −1556 | −3712 | −6231 | −5595 | −501 | −1028 | −1334 | 1369 | −5190 | 2082 | −254 | −5079 | −2101 | −4812 | −829 | −151 | −2189 | 1469 | 688 | −1281 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11566 | −12609 | −894 | −1115 | −2962 | −198 | * | * | | | | | | | | | | | | |
| 19 | −1322 | −3745 | −2677 | −5608 | −383 | −2432 | −4332 | 1336 | −2824 | 182 | −618 | −5101 | 3031 | −4833 | −1471 | 145 | −2345 | 817 | −804 | −3860 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11599 | −12641 | −894 | −1115 | −3028 | −189 | * | * | | | | | | | | | | | | |
| 20 | −836 | −1069 | −2535 | −5034 | −215 | −2606 | −4213 | −227 | 764 | −103 | −625 | −4803 | 2922 | −2160 | 1065 | −233 | −1251 | −448 | −4301 | −1332 | 32 |
| — | −149 | −500 | 233 | 43 | −377 | 400 | 105 | −626 | 210 | −466 | −721 | 275 | 394 | 45 | 96 | 359 | 117 | −369 | −295 | −249 | |
| H | −14 | −6676 | −12667 | −984 | −1016 | −4362 | −72 | * | * | | | | | | | | | | | | |
| 21 | −1201 | −5128 | 60 | −591 | −5449 | −811 | 523 | −2380 | 2060 | −1867 | 37 | −411 | 481 | 657 | 1026 | 900 | −474 | −2848 | −5311 | −7 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −24 | −11625 | −5933 | −894 | −1115 | −4362 | −72 | * | * | | | | | | | | | | | | |
| 22 | −1324 | −5089 | −714 | −2318 | 3372 | −792 | 472 | −2325 | 701 | −2573 | −213 | −469 | −1445 | 1215 | 667 | −2258 | −2324 | −4707 | −194 | −585 | 36 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11601 | −12643 | −894 | −1115 | −4468 | −67 | * | * | | | | | | | | | | | | |
| 23 | 889 | 2045 | −344 | −1322 | 1687 | −5147 | 1768 | −683 | −2437 | −1517 | 1296 | −1943 | −5216 | −1701 | −654 | −658 | 816 | 1001 | −4455 | 317 | 37 |
| — | −149 | −502 | 233 | 41 | −372 | 397 | 107 | −623 | 209 | −466 | −714 | 274 | 392 | 49 | 94 | 357 | 119 | −369 | −296 | −241 | |
| H | −341 | −2983 | −3572 | −287 | −2469 | −408 | −2021 | * | * | | | | | | | | | | | | |
| 24 | 1882 | 1400 | −1606 | −1393 | −5465 | −4723 | −982 | −1414 | 989 | −1497 | −724 | −2300 | 922 | −1580 | 1803 | 24 | −1686 | −877 | −5360 | −1605 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1 | −11712 | −12754 | −894 | −1115 | −2656 | −249 | * | * | | | | | | | | | | | | |
| 25 | −39 | −5224 | 671 | 2363 | −5543 | −2629 | −997 | −781 | −115 | −1549 | −284 | −71 | −2175 | −2927 | 111 | 1013 | −853 | −133 | −5408 | −4726 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1 | −11730 | −12772 | −894 | −1115 | −813 | −1214 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | 99 | −5308 | 587 | 333 | −1100 | −1233 | −11 | −510 | 1327 | −2377 | −4397 | 2690 | −4903 | −858 | 344 | −1370 | −737 | −1276 | −5491 | −1774 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11817 | −12859 | −894 | −1115 | −2742 | −233 | * | * | | | | | | | | | | | | |
| 27 | −2477 | 875 | −1647 | −1871 | 1782 | 1954 | 2319 | −1335 | −930 | −2397 | 222 | −178 | −488 | −2431 | −2730 | −774 | −3877 | −135 | −4986 | 1760 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −14 | −11817 | −6757 | −894 | −1115 | −1989 | −419 | * | * | | | | | | | | | | | | |
| 28 | −2471 | −3948 | −6460 | −1025 | 2384 | −3139 | −4538 | 1570 | −2564 | 2143 | 1367 | −2731 | −5717 | −5044 | −2577 | −2245 | −4061 | −1078 | −423 | −4063 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11812 | −12854 | −894 | −1115 | −1801 | −488 | * | * | | | | | | | | | | | | |
| 29 | −2400 | −5291 | 796 | −225 | −5600 | −2948 | −51 | −667 | −868 | −2416 | −132 | 1555 | 3005 | −3029 | −2064 | 210 | −1356 | −679 | −1031 | −4806 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −30 | −11825 | −5615 | −894 | −1115 | −2586 | −263 | * | * | | | | | | | | | | | | |
| 30 | −858 | −5289 | −2103 | 1325 | −106 | −1540 | 483 | −2560 | 2266 | −543 | −4378 | 420 | 175 | 1107 | 568 | −2226 | −1072 | −4911 | −5472 | −1830 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −466 | −11796 | −1858 | −894 | −1115 | −3049 | −186 | * | * | | | | | | | | | | | | |
| 31 | −86 | −4642 | −3357 | 577 | −1091 | −2295 | 2060 | 126 | −1007 | 1469 | −1127 | −1606 | 1471 | −845 | −415 | −905 | −1304 | −4215 | −4882 | 964 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11331 | −12373 | −894 | −1115 | −523 | −1717 | * | * | | | | | | | | | | | | |
| 32 | −2984 | −5231 | 768 | 538 | −131 | 1690 | −766 | 327 | 140 | −732 | −4320 | −173 | −2338 | −1032 | 1016 | 383 | −348 | −1274 | −5415 | −4732 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −377 | −11736 | −2123 | −894 | −1115 | −3670 | −118 | * | * | | | | | | | | | | | | |
| 33 | −351 | 1657 | 349 | 882 | −1541 | 245 | −81 | −2245 | −491 | −1149 | 1257 | −131 | 299 | 467 | −319 | 408 | 136 | −660 | −5058 | 102 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −229 | −11360 | −2775 | −894 | −1115 | −5205 | −40 | * | * | | | | | | | | | | | | |
| 34 | 23 | 1529 | −1087 | −620 | −847 | 1543 | 843 | −1962 | 949 | −4688 | −3761 | 677 | −4266 | −270 | 630 | 1040 | 131 | −2828 | −4855 | −4172 | 50 |
| — | −149 | −505 | 234 | 52 | −386 | 393 | 103 | −627 | 221 | −468 | −709 | 274 | 392 | 54 | 96 | 355 | 114 | −372 | −300 | −255 | |
| S | −6297 | −768 | −1322 | −5 | −8116 | −5607 | −30 | * | * | | | | | | | | | | | | |
| 35 | −106 | −4004 | 772 | −1207 | −4319 | 1648 | 1320 | 74 | −1761 | −4017 | −3094 | 1690 | 236 | −308 | −2268 | 451 | −8 | −2166 | −4190 | 63 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −66 | −10396 | −4503 | −894 | −1115 | −6257 | −19 | * | * | | | | | | | | | | | | |
| 36 | −1724 | −3696 | −2494 | 698 | −3908 | 83 | −65 | 1223 | −1850 | −563 | −2815 | −489 | 1418 | 195 | 73 | −713 | −26 | 1477 | −3948 | −3338 | 53 |
| — | −152 | −503 | 233 | 42 | −384 | 402 | 102 | −627 | 211 | −468 | −724 | 274 | 402 | 48 | 93 | 359 | 117 | −366 | −298 | −253 | |
| . | −5496 | −636 | −1580 | −8 | −7452 | −6291 | −19 | * | * | | | | | | | | | | | | |
| 37 | 299 | 8 | −1862 | 757 | −3744 | −337 | −1641 | −3484 | 1403 | −3447 | −2531 | −10 | −3073 | −1186 | −751 | 1444 | 1155 | 417 | 190 | −2957 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −2 | −9745 | −10787 | −894 | −1115 | −4814 | −52 | * | * | | | | | | | | | | | | |
| 38 | 636 | −3610 | −2012 | −1458 | −3936 | 554 | −1772 | −3678 | 1321 | −2237 | −2702 | 696 | −3217 | 2547 | −352 | −2038 | 1610 | −3236 | −3786 | −3117 | 56 |
| — | −144 | −505 | 234 | 44 | −386 | 402 | 101 | −628 | 212 | −469 | −700 | 270 | 391 | 40 | 93 | 359 | 119 | −361 | −299 | −254 | |
| . | −681 | −1412 | −10905 | −1845 | −471 | −47 | −4953 | * | * | | | | | | | | | | | | |
| 39 | −1011 | −5333 | 322 | 1621 | −5649 | −2604 | −3505 | 9 | 1083 | −226 | 1105 | −2263 | −98 | −202 | −2367 | −552 | 1443 | 14 | −5519 | −4839 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11852 | −12895 | −894 | −1115 | −1958 | −429 | * | * | | | | | | | | | | | | |
| 40 | −185 | −3987 | −2308 | −1313 | 247 | −5705 | −4575 | 2511 | −709 | 1058 | 1653 | −2164 | −5755 | −5079 | −5258 | −4789 | −1048 | 1331 | −4445 | −2586 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11852 | −12895 | −894 | −1115 | −1958 | −429 | * | * | | | | | | | | | | | | |
| 41 | −1353 | 224 | −198 | −860 | −1555 | −5062 | −3760 | 675 | 749 | 453 | −1173 | −70 | −3250 | −1052 | −328 | −889 | 1727 | 1121 | −5094 | 391 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11852 | −12895 | −894 | −1115 | −1958 | −429 | * | * | | | | | | | | | | | | |
| 42 | −1303 | −4020 | −6543 | −5907 | 677 | −5747 | −4619 | 623 | −1076 | 2402 | 1511 | −5393 | −5794 | −5124 | −266 | −4832 | −613 | 1031 | −4480 | −4140 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11852 | −12895 | −894 | −1115 | −1958 | −429 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 43 | −2118 | −792 | −2587 | 908 | −5375 | −3251 | 47 | −1409 | 1011 | 879 | 2175 | −3583 | −4998 | 362 | 1036 | −374 | −95 | 583 | −5379 | −414 | 71 |
| — | −150 | −501 | 234 | 42 | −382 | 399 | 105 | −624 | 209 | −467 | −713 | 274 | 393 | 47 | 95 | 359 | 122 | −370 | −295 | −250 | |
| E | −13 | −6816 | −12895 | −2988 | −194 | −875 | −1137 | * | * | | | | | | | | | | | | |
| 44 | −1278 | −5338 | 2972 | −3200 | −5647 | 1062 | 160 | −5390 | −3117 | −3362 | −4431 | 1653 | −2557 | −363 | −3622 | 173 | −174 | −1219 | −5529 | −1499 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11867 | −12909 | −894 | −1115 | −1468 | −647 | * | * | | | | | | | | | | | | |
| 45 | −80 | −5324 | −2555 | 1424 | −1726 | −1044 | −3526 | −664 | 901 | 78 | −422 | −2152 | 1725 | 455 | 497 | −886 | −339 | −575 | −5516 | −1840 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11867 | −12909 | −894 | −1115 | −1468 | −647 | * | * | | | | | | | | | | | | |
| 46 | −821 | −5355 | 1373 | 583 | −1137 | 545 | 2215 | −2643 | 15 | −2308 | −1636 | 829 | −4950 | −273 | −546 | 1330 | −2253 | −3447 | 1762 | −1220 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11867 | −12909 | −894 | −1115 | −1468 | −647 | * | * | | | | | | | | | | | | |
| 47 | −1768 | −5363 | 242 | −285 | −2796 | 3350 | −3522 | −5435 | −867 | −5379 | −635 | −2574 | −4956 | −1549 | −624 | −1906 | −1093 | −4985 | −5547 | −4864 | 84 |
| — | −152 | −503 | 229 | 42 | −381 | 398 | 102 | −630 | 215 | −468 | −717 | 272 | 390 | 42 | 96 | 373 | 119 | −368 | −298 | −253 | |
| S | −185 | −3056 | −12909 | −1030 | −971 | −370 | −2145 | * | * | | | | | | | | | | | | |
| 48 | −1398 | −239 | −1571 | 124 | −1701 | −1603 | −470 | −1486 | 2189 | −1381 | −164 | 576 | −4967 | −241 | 2134 | −835 | −405 | −411 | −5543 | −2032 | 93 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11881 | −12923 | −894 | −1115 | −701 | −1378 | * | * | | | | | | | | | | | | |
| 49 | −1393 | −1244 | −3845 | 679 | −1459 | −4922 | −1896 | −1053 | 1441 | −2358 | −2336 | −935 | −561 | 256 | −742 | 1644 | 1259 | 811 | −430 | −4795 | 94 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11881 | −12923 | −894 | −1115 | −701 | −1378 | * | * | | | | | | | | | | | | |
| 50 | −4213 | −1089 | −6555 | −5921 | −437 | −5759 | −4613 | −1038 | −5516 | −3074 | −87 | −5402 | −5808 | −1438 | −1356 | −3032 | −4154 | −1543 | 5926 | 887 | 95 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11881 | −12923 | −894 | −1115 | −701 | −1378 | * | * | | | | | | | | | | | | |
| 51 | −1546 | −1054 | 648 | 1209 | −1309 | −4870 | −619 | −2930 | 1079 | −669 | −1784 | 648 | 478 | 572 | 951 | −67 | 994 | −1650 | −5552 | −4869 | 96 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11881 | −12923 | −894 | −1115 | −701 | −1378 | * | * | | | | | | | | | | | | |
| 52 | −308 | −4032 | −6554 | −5919 | 2287 | −3274 | −4631 | 121 | −5515 | 375 | 1444 | −5404 | −5807 | −5139 | −5316 | −527 | −143 | 2509 | −4496 | −4154 | 97 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11881 | −12923 | −894 | −1115 | −701 | −1378 | * | * | | | | | | | | | | | | |
| 53 | −1263 | −5366 | −249 | −113 | −2060 | 114 | −1277 | −1652 | 1874 | −1253 | −1588 | 531 | −4964 | 201 | 1748 | −502 | −332 | −312 | −5550 | 724 | 98 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11881 | −12923 | −894 | −1115 | −701 | −1378 | * | * | | | | | | | | | | | | |
| 54 | −4187 | 1014 | −6532 | −5896 | 273 | −2864 | 1491 | 429 | −5491 | 1830 | 1482 | −5380 | −5784 | −2303 | −5291 | −4819 | −1633 | 1018 | −477 | 2556 | 99 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11881 | −12923 | −894 | −1115 | −701 | −1378 | * | * | | | | | | | | | | | | |
| 55 | −1065 | 634 | −4 | −299 | −5644 | −2306 | −3539 | 360 | 1372 | 298 | −1820 | −557 | −4972 | −534 | 1695 | 733 | 173 | −485 | −620 | −4856 | 100 |
| — | −149 | −483 | 235 | 41 | −379 | 397 | 103 | −622 | 211 | −465 | −723 | 275 | 391 | 43 | 95 | 358 | 120 | −368 | −285 | −252 | |
| E | −1003 | −4172 | −1166 | −1582 | −586 | −701 | −1378 | * | * | | | | | | | | | | | | |
| 56 | −1330 | −4079 | −866 | −2762 | 2008 | 1322 | 1447 | −3845 | 77 | −2584 | −537 | −3015 | −4342 | −794 | −112 | −382 | −1510 | −1167 | 1529 | 2755 | 107 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1 | −11030 | −12072 | −894 | −1115 | −3248 | −160 | * | * | | | | | | | | | | | | |
| 57 | −1250 | −449 | 434 | −93 | −1417 | −1613 | −203 | −4740 | 141 | −3038 | −822 | 1042 | −1739 | −181 | 2206 | −645 | −3135 | −4290 | 3884 | 726 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1 | −11130 | −12172 | −894 | −1115 | −694 | −1389 | * | * | | | | | | | | | | | | |
| 58 | −1495 | −5140 | −77 | −821 | −5461 | 446 | −3300 | −1866 | 1848 | −2033 | 93 | 1549 | 876 | −1627 | 2136 | −2409 | −1161 | −4762 | −5323 | −2026 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −135 | −11638 | −3492 | −894 | −1115 | −47 | −4974 | * | * | | | | | | | | | | | | |
| 59 | −1198 | −5263 | 768 | 251 | −5584 | −459 | 500 | −734 | 658 | −5279 | −4352 | 1714 | −4857 | 49 | −916 | 1805 | −166 | −1048 | −5446 | 13 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11768 | −12810 | −894 | −1115 | −3373 | −146 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 60 | −360 | −395 | 191 | −1422 | −5584 | 1113 | −347 | −5335 | 877 | −3447 | −1591 | 1041 | 887 | −172 | 370 | 1463 | 91 | −4885 | −5446 | −4763 | 111 |
| — | −153 | −489 | 242 | 44 | −390 | 398 | 96 | −633 | 215 | −469 | −723 | 276 | 384 | 62 | 113 | 358 | 118 | −377 | −304 | −252 | |
| — | −2215 | −490 | −3780 | −3 | −9024 | −2760 | −230 | * | * | | | | | | | | | | | | |
| 61 | −2385 | 556 | 26 | 146 | −247 | 2105 | −3331 | −2524 | 335 | −3629 | −1225 | −305 | −4765 | −1657 | 1400 | 1188 | −1435 | −1727 | −5341 | −1708 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −37 | −11667 | −5303 | −894 | −1115 | −1944 | −434 | * | * | | | | | | | | | | | | |
| 62 | −874 | −5115 | −2060 | −508 | −47 | −4702 | 2073 | −1107 | 517 | −3542 | −1146 | −1741 | −4795 | 331 | 2111 | −1951 | 1519 | −1139 | 195 | 1887 | 114 |
| — | −149 | −490 | 233 | 43 | −381 | 399 | 106 | −626 | 210 | −466 | −720 | 275 | 394 | 45 | 96 | 359 | 117 | −369 | −294 | −249 | |
| — | −14 | −6686 | −12724 | −178 | −3108 | −2954 | −199 | * | * | | | | | | | | | | | | |
| 63 | −212 | −1043 | −6356 | −5720 | 1916 | −2527 | −4430 | 137 | −921 | 601 | 3091 | −5204 | −1370 | −1138 | −5115 | −1197 | −133 | 1398 | −4296 | −392 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −403 | −11698 | −2037 | −894 | −1115 | −3950 | −97 | * | * | | | | | | | | | | | | |
| 64 | −715 | −991 | −5973 | −5337 | 1643 | −5176 | −4047 | −125 | −1123 | −1317 | 1631 | −4822 | −5226 | −4555 | −271 | 678 | −1395 | 964 | 1018 | 3153 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11296 | −12338 | −894 | −1115 | −60 | −4626 | * | * | | | | | | | | | | | | |
| 65 | −4175 | −4001 | −6520 | −718 | 1864 | −2901 | −1130 | 813 | −5479 | 2367 | 1729 | −5368 | −5772 | −5102 | −5279 | −1977 | −1988 | 270 | −4459 | −1779 | 118 |
| — | −149 | −500 | 233 | 43 | −381 | 398 | 105 | −626 | 211 | −466 | −721 | 275 | 394 | 45 | 96 | 360 | 118 | −369 | −295 | −249 | |
| E | −24 | −5939 | −12910 | −102 | −3876 | −390 | −2076 | * | * | | | | | | | | | | | | |
| 66 | −72 | −1242 | −1118 | −2341 | −5683 | 1209 | −213 | −3043 | −401 | −824 | −4454 | −2005 | −1828 | 555 | 814 | 928 | 2077 | −913 | −5549 | −1666 | 120 |
| — | −149 | −500 | 236 | 42 | −381 | 399 | 105 | −627 | 210 | −465 | −721 | 279 | 393 | 45 | 95 | 358 | 117 | −368 | −295 | −250 | |
| — | −12 | −6974 | −12923 | −2625 | −255 | −701 | −1378 | * | * | | | | | | | | | | | | |
| 67 | −640 | −407 | −264 | 647 | −1781 | 1097 | −769 | −2593 | 1377 | −2565 | −4458 | 19 | −1867 | −611 | 1248 | 698 | 761 | −1767 | −5552 | −4870 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11881 | −12923 | −894 | −1115 | −701 | −1378 | * | * | | | | | | | | | | | | |
| 68 | −4966 | −793 | −2630 | −7146 | −8246 | 3698 | −7197 | −8082 | −7758 | −8309 | −7365 | −615 | −6599 | −7167 | −2976 | −919 | −5434 | −2361 | −8448 | −8304 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11881 | −12923 | −894 | −1115 | −701 | −1378 | * | * | | | | | | | | | | | | |
| 69 | −5321 | −1084 | −8066 | −7961 | −4574 | −6344 | −5694 | −5868 | −7522 | −3396 | −5570 | −6606 | −6895 | −6938 | −7191 | −2262 | −317 | −2140 | 6150 | −1774 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11881 | −12923 | −894 | −1115 | −701 | −1378 | * | * | | | | | | | | | | | | |
| 70 | −926 | −974 | −650 | 592 | −5689 | −255 | −3529 | −1502 | 2062 | −2291 | −605 | −509 | −983 | −288 | 1452 | 1037 | −379 | −1324 | −5552 | −1705 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11881 | −12923 | −894 | −1115 | −701 | −1378 | * | * | | | | | | | | | | | | |
| 71 | −786 | −309 | 834 | 1602 | −5691 | 305 | −1246 | −5441 | 1095 | −2734 | −4458 | 311 | −1429 | 477 | 1381 | 754 | −1602 | −2583 | −5553 | −4870 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11881 | −12923 | −894 | −1115 | −701 | −1378 | * | * | | | | | | | | | | | | |
| 72 | −7134 | −1300 | −9178 | −3355 | 4401 | −8818 | −6481 | −1336 | −8455 | −462 | −707 | −8190 | −8256 | −7384 | −7982 | −8061 | −6995 | −5291 | −5575 | −1043 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −6 | −11881 | −8092 | −894 | −1115 | −701 | −1378 | * | * | | | | | | | | | | | | |
| 73 | 1416 | 3659 | −6535 | −5900 | −1257 | −5737 | −4611 | −298 | −5495 | −1940 | −3220 | −2798 | −5788 | −5118 | −1983 | −956 | −844 | 2598 | −4476 | −4134 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11876 | −12918 | −894 | −1115 | −1027 | −974 | * | * | | | | | | | | | | | | |
| 74 | −386 | −459 | 874 | 946 | −2870 | −3343 | −532 | −840 | 1608 | −1612 | −1116 | 816 | −4959 | 1178 | 952 | −5 | −424 | −705 | −5547 | −4864 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11876 | −12918 | −894 | −1115 | −1027 | −974 | * | * | | | | | | | | | | | | |
| 75 | 2192 | −5362 | 2206 | 1267 | −2255 | −1412 | −1681 | −3102 | −1999 | −3014 | −4452 | −1403 | −4959 | −1005 | −2058 | 76 | −1209 | −1186 | −5546 | −4864 | 136 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11876 | −12918 | −894 | −1115 | −1027 | −974 | * | * | | | | | | | | | | | | |
| 76 | −1991 | −5094 | −3912 | −1610 | −2280 | −4954 | 3004 | −1817 | 1237 | −2029 | 66 | 3337 | −5044 | −277 | −3749 | −3023 | −1419 | −4654 | −5349 | 26 | 137 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11876 | −12918 | −894 | −1115 | −1027 | −974 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 77 | −667 | −245 | 1082 | −259 | −5686 | 2388 | 500 | −5436 | 524 | −5381 | −1645 | 448 | −1598 | 49 | 766 | −310 | −2345 | −3200 | −5548 | −4865 | 138 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11876 | −12918 | −894 | −1115 | −1027 | −974 | * | * | | | | | | | | | | | | |
| 78 | −3194 | −5215 | −7850 | −7228 | 355 | −7151 | −6005 | 547 | −989 | 2877 | −380 | −6807 | −7019 | −2580 | −6612 | −6273 | −5411 | 730 | −5578 | −5382 | 139 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11876 | −12918 | −894 | −1115 | −1027 | −974 | * | * | | | | | | | | | | | | |
| 79 | −1936 | −538 | −297 | 980 | −3251 | 39 | −1936 | −573 | 1988 | −943 | −731 | 103 | −4959 | 1259 | 1337 | −1124 | −2042 | −174 | −5544 | −4863 | 140 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11876 | −12918 | −894 | −1115 | −1027 | −974 | * | * | | | | | | | | | | | | |
| 80 | 1179 | −5328 | 813 | 1175 | −2243 | −1706 | −3536 | 318 | −1592 | −1237 | 672 | −541 | −344 | −379 | −1116 | −596 | 849 | 822 | −5521 | −4849 | 141 |
| — | −149 | −500 | 233 | 43 | −381 | 398 | 105 | −626 | 210 | −466 | −721 | 275 | 394 | 45 | 96 | 359 | 119 | −367 | −295 | −249 | |
| T | −65 | −5935 | −5169 | −101 | −3886 | −1027 | −974 | * | * | | | | | | | | | | | | |
| 81 | −4071 | −5557 | −589 | −1171 | −5873 | 3428 | −419 | −5628 | −2195 | −3151 | −4653 | 657 | −5103 | −3229 | −1142 | −1348 | −2138 | −5178 | −5738 | −1932 | 143 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11835 | −12877 | −894 | −1115 | −2391 | −305 | * | * | | | | | | | | | | | | |
| 82 | −5015 | −6636 | 3682 | 1447 | −6909 | −2265 | −1198 | −6712 | −1877 | −6632 | −5775 | −1291 | −5834 | −342 | −4932 | −1384 | −4997 | −6239 | −413 | −1805 | 144 |
| — | −150 | −464 | 231 | 42 | −373 | 397 | 104 | −626 | 213 | −467 | −722 | 274 | 392 | 44 | 94 | 359 | 116 | −365 | −296 | −251 | |
| — | −115 | −3963 | −6285 | −699 | −1381 | −769 | −1275 | * | * | | | | | | | | | | | | |
| 83 | −487 | 401 | −6492 | −5856 | 2294 | −3242 | −4568 | 876 | −2726 | 47 | −980 | −1201 | −2532 | −2373 | −5253 | 1320 | 944 | 1003 | −4435 | −12 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11843 | −12886 | −894 | −1115 | −1372 | −704 | * | * | | | | | | | | | | | | |
| 84 | −2787 | 3229 | −6529 | −5894 | 2267 | −5733 | −4606 | 630 | −5490 | 1287 | −471 | −5379 | −5782 | −5113 | −5290 | −3079 | −2562 | 1850 | −4470 | 181 | 148 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11853 | −12895 | −894 | −1115 | −1935 | −437 | * | * | | | | | | | | | | | | |
| 85 | −1838 | −4599 | −2321 | −1048 | −2221 | −2873 | −955 | 646 | −414 | 157 | −986 | −2526 | −5236 | −1842 | −749 | −763 | 2213 | 2147 | −4958 | −2067 | 149 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11853 | −12895 | −894 | −1115 | −1935 | −437 | * | * | | | | | | | | | | | | |
| 86 | −7606 | −6912 | −9559 | −9201 | 4203 | −9393 | −6724 | −1985 | −8948 | 925 | −902 | −8665 | −8548 | −7620 | −8354 | −8735 | −7427 | −2725 | −1717 | −162 | 150 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11853 | −12895 | −894 | −1115 | −1208 | −818 | * | * | | | | | | | | | | | | |
| 87 | −2603 | −5245 | −3786 | 1769 | −5519 | −3551 | −95 | −1312 | 1847 | −1816 | 1209 | −3539 | −4976 | 102 | 1562 | 99 | 164 | −916 | 175 | −56 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11862 | −12904 | −894 | −1115 | −1664 | −547 | * | * | | | | | | | | | | | | |
| 88 | −2485 | −4186 | −1474 | −1023 | 793 | −5493 | 2097 | −2547 | −2959 | 1798 | −332 | −4736 | −1620 | −1854 | 1519 | −1953 | −1104 | −441 | −1201 | 2031 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11862 | −12904 | −894 | −1115 | −1664 | −547 | * | * | | | | | | | | | | | | |
| 89 | −2427 | −494 | 1065 | −65 | −1440 | −634 | 410 | 1544 | −440 | −276 | −1424 | −920 | −1603 | −1949 | −102 | 279 | −864 | 1597 | −5438 | −4793 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11862 | −12904 | −894 | −1115 | −937 | −1066 | * | * | | | | | | | | | | | | |
| 90 | −702 | −1361 | 289 | 504 | −5680 | 2020 | −952 | −5430 | 831 | −2554 | −1618 | −583 | −2090 | −107 | 1025 | 68 | −2274 | −2537 | 2640 | −1574 | 154 |
| — | −145 | −500 | 244 | 44 | −382 | 406 | 100 | −632 | 207 | −471 | −717 | 273 | 392 | 41 | 93 | 360 | 119 | −373 | −300 | −255 | |
| S | −867 | −3043 | −1598 | −1614 | −571 | −1330 | −732 | * | * | | | | | | | | | | | | |
| 91 | −813 | −1495 | 1593 | 965 | −5139 | 133 | 330 | −2281 | 491 | −4834 | −3907 | 1863 | 843 | −1437 | −673 | 480 | −1651 | −1249 | −5001 | −1034 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11292 | −12334 | −894 | −1115 | −215 | −2854 | * | * | | | | | | | | | | | | |
| 92 | −942 | −5309 | −1480 | 1049 | −124 | 850 | 177 | −5380 | 588 | −633 | 1842 | 688 | −4903 | −759 | 353 | 1141 | −70 | −2850 | −5492 | −4810 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11817 | −12860 | −894 | −1115 | −2728 | −236 | * | * | | | | | | | | | | | | |
| 93 | −813 | 307 | 109 | 1332 | −999 | 869 | −304 | −1054 | 230 | −2827 | −4030 | −276 | −998 | −19 | 774 | −102 | 649 | 322 | 134 | −4449 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11817 | −12860 | −894 | −1115 | −1802 | −488 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 94 | −219 | −774 | −1009 | 334 | 2838 | −743 | −3525 | −2301 | 47 | 971 | −170 | −1569 | −1561 | −888 | −844 | −3044 | 329 | −4783 | −5411 | 383 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11829 | −12871 | −894 | −1115 | −2517 | −277 | * | * | | | | | | | | | | | | |
| 95 | −1170 | −709 | −884 | −94 | −705 | −2112 | 2240 | −3390 | 638 | −720 | −514 | 425 | −1745 | −979 | 868 | 203 | 1794 | −1287 | 453 | 80 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11829 | −12871 | −894 | −1115 | −1378 | −701 | * | * | | | | | | | | | | | | |
| 96 | −2559 | −576 | −1390 | −1498 | −154 | −5694 | −637 | 769 | −5430 | −645 | −278 | −2670 | 2196 | −5059 | −1547 | −2992 | −1263 | 2610 | −4439 | −774 | 166 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −11 | −11844 | −7067 | −894 | −1115 | −2177 | −361 | * | * | | | | | | | | | | | | |
| 97 | −1474 | −1086 | −857 | −2043 | −5257 | 384 | 828 | −16 | 86 | 348 | 2090 | −488 | −5005 | −1063 | −341 | −139 | 444 | 1465 | −5306 | 40 | 167 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11834 | −12876 | −894 | −1115 | −2421 | −298 | * | * | | | | | | | | | | | | |
| 98 | 55 | −1717 | −6487 | −5851 | 677 | −749 | −2129 | 2244 | −3000 | 1465 | −571 | −2540 | −1952 | −5068 | −5245 | −3135 | −618 | 1261 | 934 | −4083 | 168 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11834 | −12876 | −894 | −1115 | −2421 | −298 | * | * | | | | | | | | | | | | |
| 99 | −4097 | −880 | −5619 | −3136 | 2448 | −5533 | 253 | −347 | 514 | 397 | −3292 | −2473 | −2815 | 24 | 1735 | 875 | −4038 | −323 | −867 | 628 | 169 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11834 | −12876 | −894 | −1115 | −1547 | −604 | * | * | | | | | | | | | | | | |
| 100 | −2524 | −5302 | 1112 | −598 | 1148 | 710 | −3505 | −868 | 201 | 917 | −1837 | 156 | −4938 | −1026 | 2152 | −1428 | −3805 | −2768 | −5495 | −4821 | 170 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11844 | −12887 | −894 | −1115 | −1664 | −547 | * | * | | | | | | | | | | | | |
| 101 | 25 | 3255 | −4103 | −1296 | −967 | −375 | 619 | −92 | 374 | −653 | −3967 | −790 | 814 | −816 | 1352 | −661 | −1692 | 466 | −1724 | −2054 | 171 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11850 | −12892 | −894 | −1115 | −719 | −1349 | * | * | | | | | | | | | | | | |
| 102 | −1514 | −1023 | −46 | −1011 | −1703 | −643 | −987 | −1471 | −850 | −2863 | −2333 | 927 | 1366 | −132 | 373 | 2008 | −21 | −344 | −610 | −669 | 172 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11869 | −12911 | −894 | −1115 | −396 | −2060 | * | * | | | | | | | | | | | | |
| 103 | −111 | 1629 | −228 | 206 | −641 | 1104 | 1393 | −3223 | 1048 | −1365 | −707 | −614 | −2168 | −468 | 626 | −264 | 891 | −1460 | −5550 | −2101 | 173 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11881 | −12923 | −894 | −1115 | −701 | −1378 | * | * | | | | | | | | | | | | |
| 104 | −759 | 3024 | −293 | 935 | −5674 | −1145 | −2048 | −144 | 597 | −1133 | −955 | 337 | 441 | 152 | −1149 | −2 | 266 | −522 | −1791 | 212 | 174 |
| — | * | * | * | * | * | * | * | * | * | * | * | * | * | * | * | * | * | * | * | * | |
| — | * | * | * | * | * | * | * | * | 0 | | | | | | | | | | | | |
| // | | | | | | | | | | | | | | | | | | | | | |

HMMER2.0 [2.3.2]
NAME Cu-oxidase
ACC PF00394.14
DESC Multicopper oxidase
LENG 189
ALPH Amino
RF no
CS yes
MAP yes
COM hmmbuild -F HMM_ls.ann SEED.ann
COM hmmcalibrate --seed 0 HMM_ls.ann
NSEQ 72
DATE Thu Apr 24 19:20:05 2008
CKSUM 4184
GA −18.9000 −18.9000;
TC −18.6000 −18.6000;
NC −19.1000 −19.1000;
XT −8455 −4 −1000 −1000 −8455 −4 −8455 −4
NULT −4 −8455
NULE 595 −1558 85 338 −294 453 −1158 197 249 902 −1085 −142 −21 −313 45 531 201 384 −1998 −644
EVD −98.859215 0.169857

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | −44 | * | −5045 | | | | | | | | | | | | | | | | | | |
| 1 | −720 | −3824 | 1695 | 2320 | 154 | 815 | −547 | −3896 | 780 | −3840 | −2914 | 22 | −3416 | −1522 | 102 | −2230 | −1286 | −3446 | −4007 | −3324 | 1 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −354 | −10161 | −2205 | −894 | −1115 | −701 | −1378 | −44 | * | | | | | | | | | | | | |
| 2 | −167 | −3422 | 1897 | 1450 | 276 | −3051 | −1714 | −389 | −1313 | −853 | −2523 | 226 | −3143 | −582 | −234 | 970 | −239 | −430 | −3632 | −2977 | 2 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9809 | −10851 | −894 | −1115 | −403 | −2036 | * | * | | | | | | | | | | | | |
| 3 | −1663 | −2460 | −4151 | −3555 | 1059 | −690 | 667 | −280 | −1027 | −1072 | −1657 | 1036 | −4012 | −985 | −312 | −3004 | 1789 | 1044 | 887 | 2233 | 3 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10093 | −11135 | −894 | −1115 | −307 | −2384 | * | * | | | | | | | | | | | | |
| 4 | −2588 | −2415 | −4933 | −4296 | 72 | −4135 | −3006 | 981 | −3891 | −17 | 142 | −1579 | 1315 | −3515 | −3692 | −1719 | 1824 | 2047 | 6 | 373 | 4 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 5 | −3759 | −3472 | −137 | −5559 | 814 | −5480 | −4370 | 2747 | −5211 | 1583 | −2050 | −5127 | −5382 | −4735 | −4999 | −4611 | −3695 | 1308 | 685 | −3707 | 5 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −148 | −10161 | −3368 | −894 | −1115 | −701 | −1378 | * | * | | | | | | | | | | | | |
| 6 | −2456 | −2298 | −4699 | −256 | 27 | −50 | 163 | 728 | −3687 | 1186 | 1259 | −3604 | −583 | −3330 | −3524 | −755 | 2225 | −72 | −2754 | −2409 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10015 | −11057 | −894 | −1115 | −191 | −3009 | * | * | | | | | | | | | | | | |
| 7 | −1690 | −2417 | −4928 | −80 | 505 | −1374 | −3007 | 853 | −3889 | 2504 | 73 | −812 | −4186 | −3513 | −3691 | −3221 | −2530 | 317 | 803 | −2532 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 8 | 1038 | −3822 | −755 | −594 | −273 | 1632 | −1984 | −3892 | −514 | −3838 | −2912 | −134 | −3417 | −140 | −2074 | 1675 | 1158 | −3444 | −4006 | −3324 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 9 | −4713 | −6794 | 3776 | 1480 | −6944 | −4410 | −3898 | −6968 | −4379 | −6785 | −6261 | −2999 | −5018 | −3598 | −5450 | −57 | −4831 | −6380 | −6987 | −5814 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 10 | −6394 | −302 | −7091 | −7330 | 212 | −6901 | 1630 | −5357 | −6892 | −1320 | −762 | −5609 | −6776 | −5715 | −6311 | −6127 | −6266 | −5474 | 5870 | 1249 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −22 | −10161 | −6152 | −894 | −1115 | −701 | −1378 | * | * | | | | | | | | | | | | |
| 11 | −6765 | −5695 | −7158 | −7506 | 966 | −7038 | 309 | −5663 | −7061 | −4981 | −5069 | −1071 | −6894 | −5791 | −6429 | −6284 | 17 | −5813 | 3916 | 4259 | 11 |
| — | −149 | −500 | 232 | 43 | −381 | 398 | 105 | −624 | 210 | −465 | −721 | 275 | 393 | 45 | 95 | 360 | 117 | −366 | −295 | −250 | |
| T | −199 | −2960 | −11184 | −45 | −5013 | −1076 | −928 | * | * | | | | | | | | | | | | |
| 12 | −2326 | −3796 | 675 | 18 | −4116 | −3300 | 3975 | −2019 | 1065 | −2079 | −2885 | 840 | 679 | −1500 | −1062 | −2207 | −450 | −3417 | −3980 | 529 | 13 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −53 | −10142 | −4826 | −894 | −1115 | −1076 | −928 | * | * | | | | | | | | | | | | |
| 13 | 786 | −3751 | 230 | 384 | −4070 | −1301 | −274 | −1011 | 1586 | −3766 | −50 | −1892 | −3349 | 688 | 472 | −994 | 1486 | 160 | −3935 | −1172 | 14 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −2 | −10090 | −11133 | −894 | −1115 | −1164 | −853 | * | * | | | | | | | | | | | | |
| 14 | 370 | −3726 | 1722 | −1621 | −4026 | −215 | −1946 | −1219 | −477 | −1032 | −2821 | 1797 | 1081 | −291 | −2038 | 322 | 483 | −1322 | −3922 | −884 | 15 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −10111 | −11153 | −894 | −1115 | −1506 | −626 | * | * | | | | | | | | | | | | |
| 15 | 1564 | −3189 | −871 | 5 | −941 | −1352 | 2653 | 77 | −1913 | −3113 | 608 | −505 | 189 | −1843 | −2350 | 336 | −202 | 612 | −3512 | −753 | 16 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10111 | −11153 | −894 | −1115 | −359 | −2183 | * | * | | | | | | | | | | | | |
| 16 | −2341 | −3813 | 635 | 532 | −1039 | −1745 | 1498 | −3884 | 1568 | −1138 | 297 | 177 | 802 | 319 | −912 | 219 | 728 | −484 | −3997 | −1235 | 17 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 17 | 595 | −3802 | 1396 | 1283 | −4117 | −168 | −1977 | −848 | −991 | −77 | −2893 | −513 | −3411 | −307 | −1026 | 319 | 905 | 157 | −3989 | −3309 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −260 | −10161 | −2607 | −894 | −1115 | −701 | −1378 | * | * | | | | | | | | | | | | |
| 18 | −1268 | −2238 | −4325 | −3713 | −2198 | −3852 | −320 | 267 | −369 | 2029 | 568 | −586 | 351 | 902 | −3314 | −2920 | −1136 | 1213 | −2689 | 26 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −9903 | −10946 | −894 | −1115 | −2890 | −209 | * | * | | | | | | | | | | | | |
| 19 | −293 | 716 | −2595 | 1308 | −1122 | −1596 | −2097 | −114 | 780 | −572 | −2010 | −577 | −3462 | 827 | 386 | −2336 | 110 | 996 | 823 | 1181 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −2 | −9903 | −10946 | −894 | −1115 | −2890 | −209 | * | * | | | | | | | | | | | | |
| 20 | 426 | −3598 | 149 | 171 | −3918 | −3101 | −1759 | −3668 | 1624 | −1094 | −442 | 1095 | −297 | 1122 | 275 | −20 | −1062 | 470 | 763 | −3099 | 21 |
| — | −148 | −502 | 234 | 47 | −379 | 396 | 107 | −619 | 209 | −467 | −723 | 273 | 391 | 55 | 98 | 358 | 115 | −372 | −297 | −249 | |
| C | −1500 | −693 | −5173 | −12 | −6974 | −2890 | −209 | * | * | | | | | | | | | | | | |
| 21 | 970 | −3422 | −68 | 256 | −1242 | 266 | −1773 | −3389 | −444 | 1346 | −2528 | −1770 | −669 | −356 | −1877 | 127 | −351 | −1312 | −3644 | 1437 | 23 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −9864 | −10906 | −894 | −1115 | −3039 | −187 | * | * | | | | | | | | | | | | |
| 22 | 14 | −2288 | 1652 | 390 | 1499 | −3729 | −2550 | 64 | −2981 | 1145 | 1324 | −3078 | −1635 | −135 | −3060 | −1516 | −424 | −426 | −2728 | −53 | 24 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −9864 | −10906 | −894 | −1115 | −3039 | −187 | * | * | | | | | | | | | | | | |
| 23 | 1493 | −3564 | −415 | −583 | 239 | 265 | −1727 | −3634 | 1072 | −1192 | 511 | 110 | −3161 | 850 | 219 | 936 | −1156 | −3186 | −3748 | −3066 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −31 | −9864 | −5628 | −894 | −1115 | −3039 | −187 | * | * | | | | | | | | | | | | |
| 24 | −2074 | −3527 | −570 | −392 | −3839 | 1481 | 10 | −3584 | −1295 | −1550 | −2619 | −606 | −69 | −1253 | −674 | 1780 | 1821 | −969 | −3716 | −3038 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −160 | −9835 | −3269 | −894 | −1115 | −3135 | −174 | * | * | | | | | | | | | | | | |
| 25 | 520 | −3392 | −285 | −1255 | −3702 | 1941 | 62 | −3445 | 103 | −353 | −2484 | −1564 | −1179 | 45 | 1521 | −6 | −813 | −1329 | 853 | −2906 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −67 | −9678 | −4511 | −894 | −1115 | −3548 | −129 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | 883 | −3341 | −242 | 446 | −907 | 429 | −1533 | −3392 | 1652 | −312 | −2433 | 78 | −2967 | −1077 | −162 | −1065 | 572 | −334 | −3531 | 408 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −147 | −9614 | −3390 | −894 | −1115 | −1582 | −587 | * | * | | | | | | | | | | | | |
| 27 | 1082 | −3393 | −279 | −478 | −3705 | 450 | −1578 | −226 | 596 | 815 | −2484 | 1584 | 644 | −1121 | −871 | −554 | −1880 | −3010 | −3582 | −2904 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −922 | −9671 | −1086 | −894 | −1115 | −599 | −1558 | * | * | | | | | | | | | | | | |
| 28 | 163 | −1991 | −2927 | −2352 | −1984 | 1092 | −1973 | −106 | −2160 | −749 | 549 | 379 | 2246 | −235 | −2375 | −345 | −582 | −1428 | 1604 | 1303 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −3 | −9348 | −10390 | −894 | −1115 | −4076 | −88 | * | * | | | | | | | | | | | | |
| 29 | 781 | −2252 | −2358 | 525 | 211 | −820 | −1746 | −239 | −1660 | −439 | 1587 | −1953 | 1391 | 558 | −2014 | 105 | 1346 | −1716 | −2633 | −2181 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −28 | −9348 | −5823 | −894 | −1115 | −4076 | −88 | * | * | | | | | | | | | | | | |
| 30 | 842 | −3132 | 1611 | −975 | −3447 | 1515 | −1306 | −3194 | 523 | −1050 | −2222 | −1285 | −1258 | 679 | 1246 | −1555 | −605 | −1474 | −3318 | −2639 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −3 | −9324 | −10366 | −894 | −1115 | −3658 | −119 | * | * | | | | | | | | | | | | |
| 31 | 832 | −1725 | −4229 | −3593 | 1753 | −333 | 373 | −270 | −3191 | −458 | 1542 | −3084 | −3493 | −2817 | −2996 | −682 | 830 | 585 | 3488 | 64 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1563 | −9350 | −599 | −894 | −1115 | −4074 | −88 | * | * | | | | | | | | | | | | |
| 32 | −904 | −1969 | 709 | 560 | −2123 | −1840 | −600 | −1785 | −316 | −1915 | −1110 | −547 | −1985 | 1473 | −798 | −863 | −852 | 2251 | −2241 | 963 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −10 | −7796 | −8838 | −894 | −1115 | −4043 | −90 | * | * | | | | | | | | | | | | |
| 33 | 527 | −2376 | 884 | 1350 | −2691 | −1803 | −505 | −2447 | 604 | −2389 | −1470 | 2000 | 574 | 796 | −629 | −760 | −832 | −1995 | −2558 | −1864 | 35 |
| — | −149 | −500 | 232 | 42 | −379 | 398 | 105 | −627 | 210 | −465 | −717 | 275 | 395 | 45 | 95 | 360 | 117 | −365 | −295 | −247 | |
| H | −3125 | −349 | −3321 | −34 | −5420 | −4873 | −50 | * | * | | | | | | | | | | | | |
| 34 | −872 | −991 | −2003 | −1442 | −784 | −2222 | 1526 | −535 | −1218 | −843 | 3209 | 1888 | −2288 | −1053 | −1402 | −1248 | −813 | 862 | −1255 | 1170 | 37 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −10 | −7811 | −8853 | −894 | −1115 | −4909 | −49 | * | * | | | | | | | | | | | | |
| 35 | −1537 | −2718 | 361 | −833 | −3161 | −2368 | −740 | −2788 | 2124 | −2645 | −1832 | −1021 | −2417 | −307 | 2693 | −1423 | −1404 | −2436 | 2723 | −2237 | 38 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −10 | −7811 | −8853 | −894 | −1115 | −92 | −4010 | * | * | | | | | | | | | | | | |
| 36 | −163 | −2909 | −2940 | 544 | −473 | 44 | −2354 | 570 | −1284 | −2801 | 262 | −2546 | 3000 | −2145 | −401 | −1489 | −26 | −793 | −3285 | −2826 | 39 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −146 | −10110 | −3395 | −894 | −1115 | −1519 | −619 | * | * | | | | | | | | | | | | |
| 37 | −1667 | −2367 | −3971 | −3378 | −1099 | 842 | −2657 | −1171 | −3117 | 855 | 423 | 1756 | 2521 | −2875 | −407 | −2877 | 256 | −1791 | −2809 | −2443 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −256 | −9966 | −2629 | −894 | −1115 | −873 | −1140 | * | * | | | | | | | | | | | | |
| 38 | −499 | −2912 | −2396 | 1160 | −3013 | −378 | −333 | 1115 | −1729 | −1405 | 925 | −113 | 479 | −696 | −1367 | −1347 | 1234 | 1382 | −3245 | −2730 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2 | −9837 | −10879 | −894 | −1115 | −469 | −1850 | * | * | | | | | | | | | | | | |
| 39 | 442 | −2859 | −3850 | −3314 | −1478 | −874 | −2963 | −2617 | −3128 | −1104 | −2240 | −3241 | 3218 | 481 | −3341 | 1420 | −2630 | −964 | −3468 | −3077 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2 | −10086 | −11128 | −894 | −1115 | −1776 | −498 | * | * | | | | | | | | | | | | |
| 40 | −818 | −3748 | 3225 | −1593 | −4063 | −1792 | −1927 | −3809 | −1512 | −1889 | −2841 | 504 | −3360 | 1700 | −650 | −10 | −1259 | −1404 | −3937 | −3258 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −10086 | −11128 | −894 | −1115 | −1776 | −498 | * | * | | | | | | | | | | | | |
| 41 | 1659 | −3496 | −2326 | −1779 | −273 | 829 | 1482 | −3420 | −927 | −3499 | −2648 | 1026 | −3450 | −1635 | −2167 | 1461 | 1077 | −1814 | −3781 | −3173 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10086 | −11128 | −894 | −1115 | −291 | −2453 | * | * | | | | | | | | | | | | |
| 42 | −854 | −2415 | −4929 | −4293 | 609 | −28 | 1566 | 1209 | −3889 | 210 | −1618 | −3780 | −4185 | −3513 | −3691 | −1824 | 1690 | 1591 | −2872 | 1399 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 43 | −2588 | −2420 | −4901 | −4267 | −2375 | −1476 | −3003 | −87 | −3869 | 2447 | 862 | −1291 | −4183 | −3499 | −1425 | −1254 | 1476 | 500 | −2878 | −2535 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 44 | −4347 | −3942 | −687 | −6315 | 2125 | −6349 | −5420 | 3262 | −6061 | −184 | 977 | −6007 | −6094 | −5542 | −5880 | −5556 | −4289 | 521 | −4813 | −4626 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 45 | −1716 | −4402 | −3121 | −2876 | −4966 | −4198 | −3074 | −4585 | −1213 | −2446 | −3863 | 4158 | −1029 | −307 | −2659 | −3422 | −3451 | −1741 | −4848 | −4365 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 46 | −1915 | −6358 | −808 | 138 | −6644 | 3527 | −3761 | −6597 | −4082 | −6452 | −5820 | −263 | −4905 | −3441 | −1500 | −2007 | −4567 | −6028 | −6649 | −5587 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −239 | −10161 | −2718 | −894 | −1115 | −701 | −1378 | * | * | | | | | | | | | | | | |
| 47 | −1442 | −3610 | −824 | −666 | −3928 | −1163 | 1662 | −3676 | 1827 | 576 | −811 | −1756 | −3213 | 1169 | 1568 | −2026 | 1140 | −1884 | −3795 | −3114 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −2 | −9924 | −10966 | −894 | −1115 | −2805 | −223 | * | * | | | | | | | | | | | | |
| 48 | −1075 | −3617 | −823 | −461 | −3937 | 2534 | −136 | −3687 | −577 | −3633 | 593 | 97 | 1534 | −1318 | −342 | 373 | −1098 | −3238 | −3800 | −3118 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −9924 | −10966 | −894 | −1115 | −2805 | −223 | * | * | | | | | | | | | | | | |
| 49 | −1331 | −3532 | −2036 | −1487 | −3816 | 1794 | −1803 | −448 | −7 | −2089 | −2631 | 811 | −330 | 1028 | 2161 | −996 | −96 | −1614 | 39 | −3079 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −124 | −9924 | −3625 | −894 | −1115 | −2177 | −360 | * | * | | | | | | | | | | | | |
| 50 | −391 | −365 | −545 | −2292 | 2191 | 345 | −2185 | −2188 | −189 | −1417 | −1761 | 625 | 868 | −2030 | −2477 | −124 | −2134 | −688 | 1254 | 2380 | 53 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −2 | −9831 | −10873 | −894 | −1115 | −3147 | −173 | * | * | | | | | | | | | | | | |
| 51 | 688 | −3337 | 403 | −1480 | −1171 | −341 | −299 | −966 | −176 | 862 | −2449 | 1800 | 166 | −496 | −972 | −1390 | −630 | 612 | −3574 | −2947 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −260 | −9831 | −2607 | −894 | −1115 | −3147 | −173 | * | * | | | | | | | | | | | | |
| 52 | 72 | 3043 | −1051 | −679 | −815 | 1731 | −1506 | −3338 | −368 | −3305 | −2390 | −600 | −1124 | −92 | −757 | 172 | −1119 | −2909 | −3490 | 2259 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −3 | −9573 | −10616 | −894 | −1115 | −3751 | −111 | * | * | | | | | | | | | | | | |
| 53 | −413 | −3340 | 622 | −1164 | −3660 | 1324 | 1240 | −3411 | −423 | −3356 | −2429 | 2123 | −944 | −1040 | −628 | 743 | 1180 | −2962 | −3523 | −2841 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −458 | −9573 | −1885 | −894 | −1115 | −3751 | −111 | * | * | | | | | | | | | | | | |
| 54 | −1605 | 3854 | −768 | −138 | −2201 | 711 | −1523 | −732 | −1388 | 731 | −1314 | −337 | 352 | −1292 | −1766 | −296 | −397 | −445 | −2516 | −2048 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −4 | −9119 | −10161 | −894 | −1115 | −4309 | −75 | * | * | | | | | | | | | | | | |
| 55 | 1679 | 78 | −1666 | −1118 | −2875 | 104 | −1354 | −2535 | 46 | −419 | −1825 | −211 | −974 | −963 | −1488 | 1650 | 898 | −2228 | −2971 | −2391 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −51 | −9119 | −4927 | −894 | −1115 | −1531 | −613 | * | * | | | | | | | | | | | | |
| 56 | 586 | −3267 | 1099 | −1117 | −3581 | −453 | −1448 | −3327 | 321 | −486 | −2359 | −1426 | 1818 | −42 | −577 | 1126 | 444 | −1479 | −3455 | −2777 | 59 |
| — | −149 | −502 | 231 | 42 | −382 | 398 | 104 | −628 | 212 | −468 | −690 | 275 | 394 | 46 | 98 | 357 | 119 | −371 | −281 | −251 | |
| — | −4672 | −3798 | −170 | −3119 | −176 | −3859 | −103 | * | * | | | | | | | | | | | | |
| 57 | −1554 | −2445 | 3678 | −97 | −2948 | −1480 | −1047 | −3051 | −1301 | −3063 | −2548 | −442 | −2000 | −825 | −1912 | −1378 | −1677 | −2649 | −2758 | −2345 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −261 | −6346 | −2705 | −894 | −1115 | −1818 | −481 | * | * | | | | | | | | | | | | |
| 58 | −244 | −2470 | 187 | −412 | −2756 | 523 | −730 | −2483 | 1866 | −104 | −1568 | −717 | −2160 | 1402 | 46 | −977 | −10 | −75 | −2674 | −103 | 73 |
| — | −148 | −500 | 233 | 43 | −381 | 398 | 106 | −626 | 210 | −466 | −721 | 275 | 394 | 45 | 96 | 360 | 117 | −369 | −294 | −249 | |
| . | −177 | −3133 | −9508 | −146 | −3376 | −3787 | −109 | * | * | | | | | | | | | | | | |
| 59 | −1156 | −2527 | 2282 | −494 | 789 | −87 | −810 | −2529 | −408 | −2526 | −1628 | −798 | −409 | 410 | 195 | 129 | 597 | −2127 | −2736 | 1243 | 75 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1636 | −8579 | −566 | −894 | −1115 | −4071 | −88 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 60 | −361 | −873 | −1860 | −1527 | −1816 | 1259 | −1343 | −1365 | −1420 | −1698 | −962 | −1248 | 961 | −1237 | −1635 | 611 | −599 | 2279 | −2163 | −1787 | 76 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −15 | −7136 | −8178 | −894 | −1115 | −3893 | −101 | * | * | | | | | | | | | | | | |
| 61 | −635 | −1664 | −736 | −302 | −2205 | 1157 | −589 | −1888 | −274 | −294 | −1148 | 1956 | 434 | −201 | −738 | 1102 | −668 | −1499 | −2276 | −1693 | 77 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −12 | −7487 | −8529 | −894 | −1115 | −4097 | −87 | * | * | | | | | | | | | | | | |
| 62 | 347 | −2242 | 1454 | 8 | −2568 | 759 | −393 | −2322 | 1095 | −2270 | −1357 | 1221 | −1804 | 56 | −530 | 767 | −720 | −1872 | −2444 | −1751 | 78 |
| — | −148 | −500 | 232 | 42 | −381 | 398 | 105 | −624 | 210 | −466 | −721 | 276 | 394 | 45 | 95 | 360 | 119 | −370 | −295 | −250 | |
| . | −2855 | −219 | −8733 | −37 | −5287 | −4936 | −48 | * | * | | | | | | | | | | | | |
| 63 | 716 | −1685 | −934 | −402 | −2187 | −279 | −634 | −1860 | −308 | −1970 | −1130 | 1205 | 80 | −245 | −768 | 1202 | 1366 | 89 | −2270 | −1698 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −10 | −7690 | −8733 | −894 | −1115 | −4936 | −48 | * | * | | | | | | | | | | | | |
| 64 | −1567 | −1526 | −2997 | −2595 | −156 | −2819 | −1143 | −1042 | −2269 | 1578 | −686 | −2199 | −2944 | −1984 | −2255 | 1380 | −1557 | −1018 | −818 | 3115 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −10 | −7690 | −8733 | −894 | −1115 | −4936 | −48 | * | * | | | | | | | | | | | | |
| 65 | −846 | −2225 | −467 | 1095 | −2571 | 691 | −487 | −2302 | 590 | −2284 | −1396 | −395 | 1992 | −52 | −600 | −735 | 1310 | −1879 | −2481 | −1813 | 82 |
| — | −149 | −500 | 232 | 43 | −381 | 398 | 107 | −627 | 210 | −466 | −717 | 275 | 394 | 47 | 95 | 359 | 118 | −368 | −295 | −246 | |
| . | −1605 | −580 | −8733 | −48 | −4946 | −4936 | −48 | * | * | | | | | | | | | | | | |
| 66 | −2749 | 4930 | −4320 | −4375 | −397 | −3436 | −1691 | −2778 | −3914 | −2689 | −2491 | −3287 | −3820 | −3424 | −3628 | −2950 | −2951 | −2691 | −1076 | 3414 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −10 | −7690 | −8733 | −894 | −1115 | −4143 | −84 | * | * | | | | | | | | | | | | |
| 67 | −817 | −2256 | 823 | 569 | −2556 | −1746 | −441 | −2297 | 1352 | 938 | −1355 | 1666 | −1864 | 8 | −554 | −697 | 145 | −1867 | −2448 | −1769 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −9 | −7847 | −8889 | −894 | −1115 | −4901 | −49 | * | * | | | | | | | | | | | | |
| 68 | −830 | −660 | −3147 | −2513 | 1167 | −2376 | −1245 | 1099 | −2115 | 1259 | 1728 | −2012 | 545 | −1742 | −1925 | −69 | −771 | 683 | 1767 | −775 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −9 | −7847 | −8889 | −894 | −1115 | −4901 | −49 | * | * | | | | | | | | | | | | |
| 69 | 406 | −2279 | −743 | −199 | −2643 | −1831 | −472 | −2364 | 1904 | −2308 | −1407 | 2122 | −1931 | −22 | 509 | 763 | −822 | −1935 | −2465 | −1829 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −100 | −7847 | −3997 | −894 | −1115 | −3746 | −112 | * | * | | | | | | | | | | | | |
| 70 | −862 | 1829 | −914 | 743 | −2308 | 1971 | −666 | −1985 | −323 | −2076 | −1232 | 558 | 580 | −263 | −798 | 121 | −839 | −295 | −2367 | −1771 | 88 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −8 | −8000 | −9043 | −894 | −1115 | −2407 | −301 | * | * | | | | | | | | | | | | |
| 71 | 1036 | −2650 | −1048 | −499 | −2964 | 202 | −830 | −2709 | 624 | −2663 | −1741 | 21 | −593 | 654 | 465 | 448 | 1106 | −2268 | −2837 | 1682 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −5 | −8649 | −9691 | −894 | −1115 | −2910 | −206 | * | * | | | | | | | | | | | | |
| 72 | −397 | −2439 | 1630 | 889 | −2607 | 1212 | −1223 | −107 | −924 | −2393 | −1593 | −1250 | −2610 | −854 | −1388 | −1460 | 741 | 1406 | −2753 | −2188 | 90 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −106 | −8891 | −3860 | −894 | −1115 | −1367 | −708 | * | * | | | | | | | | | | | | |
| 73 | 791 | −3219 | 165 | 258 | −184 | 1386 | −1385 | −3287 | −66 | −1023 | −2309 | 743 | 572 | 699 | −1474 | −319 | 426 | −1595 | −3404 | −2723 | 91 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −3 | −9432 | −10474 | −894 | −1115 | −2342 | −317 | * | * | | | | | | | | | | | | |
| 74 | 1182 | 3018 | −3288 | −2707 | −175 | 485 | −2213 | −255 | −1247 | −1048 | −1302 | −665 | −3477 | −245 | −372 | 552 | 368 | 622 | −2540 | −548 | 92 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −3 | −9566 | −10609 | −894 | −1115 | −3763 | −110 | * | * | | | | | | | | | | | | |
| 75 | 905 | −3326 | 1565 | 76 | −3645 | −1193 | −1489 | −3395 | 74 | −138 | 69 | 586 | 798 | 481 | −1578 | 797 | −885 | −1378 | −3510 | −2828 | 93 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −3 | −9566 | −10609 | −894 | −1115 | −955 | −1046 | * | * | | | | | | | | | | | | |
| 76 | −559 | −2286 | −3997 | −988 | 392 | −680 | −2618 | −1799 | −3127 | 1589 | 96 | −164 | 586 | −2870 | −510 | −2838 | 1706 | −289 | −2730 | 1166 | 94 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −9896 | −10938 | −894 | −1115 | −606 | −1544 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 77 | 1262 | −2653 | −3388 | −1667 | 1676 | −103 | −2528 | −1200 | −1329 | −1157 | −1838 | −1374 | 1087 | −75 | −2895 | −673 | 825 | −672 | 1398 | 1753 | 95 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −2 | −10079 | −11121 | −894 | −1115 | −276 | −2524 | * | * | | | | | | | | | | | | |
| 78 | −1124 | −3788 | −1219 | 33 | −4097 | −457 | −1982 | 526 | 511 | −1307 | −2880 | −871 | −1577 | −353 | −89 | −244 | 1874 | 1710 | −3978 | −3303 | 96 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −2 | −10161 | −11203 | −894 | −1115 | −701 | −1378 | * | * | | | | | | | | | | | | |
| 79 | −2589 | −2415 | −4932 | −4296 | 1892 | −554 | −3007 | 1909 | −1913 | 1623 | −392 | −341 | −4186 | −3515 | −3692 | −3220 | −302 | 699 | 1265 | −2531 | 97 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −2 | −10161 | −11203 | −894 | −1115 | −701 | −1378 | * | * | | | | | | | | | | | | |
| 80 | 292 | −3814 | −232 | −226 | −4135 | −1986 | 1315 | −1174 | 699 | −1392 | −1041 | 1575 | −227 | −455 | −61 | 207 | 1894 | −3436 | −3997 | −3315 | 98 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 81 | −1210 | −2494 | −5023 | −4390 | 1142 | −575 | −3109 | 174 | −3989 | 311 | 1788 | −3879 | −4277 | −1330 | −3790 | −3320 | −2615 | 2957 | −2967 | −2627 | 99 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 82 | −2343 | 1382 | 223 | 1718 | −1542 | −3320 | −507 | −1852 | 1159 | −2316 | −866 | −961 | −3413 | 1222 | 331 | −2228 | 1654 | 44 | −3983 | −3306 | 100 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 83 | 430 | −3877 | −2280 | −1724 | −4207 | −3391 | 1216 | −3948 | 731 | −3888 | −2969 | −1119 | 2990 | 1606 | 182 | −70 | −2359 | −1901 | −4048 | −3382 | 101 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 84 | −1392 | −5570 | −1007 | −807 | −5845 | 3314 | −3258 | −5665 | −170 | −5552 | −4761 | 1170 | −4557 | −2877 | −190 | −3636 | −3893 | −5184 | −5709 | −4884 | 102 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 85 | −2470 | −3911 | −706 | 669 | −4238 | −3429 | −2070 | −3974 | 3353 | −1437 | −3004 | −2067 | −3522 | −277 | −1289 | −2352 | −440 | −110 | −4079 | −3420 | 103 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 86 | −3186 | −4048 | −3540 | −2863 | −4477 | −131 | −2753 | −484 | 881 | −4133 | −3357 | −3006 | −4262 | −2374 | 2376 | −1211 | 2868 | −2162 | −4365 | −3935 | 104 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −10161 | −11203 | −894 | −1115 | −701 | −1378 | * | * | | | | | | | | | | | | |
| 87 | −2903 | −2796 | −1823 | −367 | −2405 | −4343 | 993 | −327 | −3853 | −1603 | −1996 | −3767 | −4409 | −3530 | −3810 | −3442 | −2844 | 439 | −2951 | 4375 | 105 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 88 | −2588 | −3235 | −2959 | −2376 | −1174 | −3725 | −2391 | −2920 | 532 | 799 | 2 | −527 | −3798 | −914 | 3346 | −1756 | −1506 | −2730 | −3563 | −300 | 106 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 89 | −4002 | −3720 | −6341 | −5719 | 2446 | −5651 | −4424 | 1263 | −5352 | 2099 | 977 | −5298 | −5483 | −4754 | −5079 | −4775 | −3918 | 551 | 1957 | −299 | 107 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 90 | −1758 | −5263 | −6151 | −4677 | −3746 | −5579 | 1082 | −5258 | −2199 | −531 | −4485 | −4367 | −5528 | −3185 | 3953 | −4968 | −4723 | −5154 | −4031 | −190 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 91 | −5262 | −4694 | −7764 | −7261 | 1552 | −7562 | −6545 | 2578 | −7109 | 1756 | −356 | −7259 | −6795 | −6118 | −6751 | −6927 | −5160 | 1578 | −5190 | −5318 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 92 | −97 | 1070 | −4938 | −4302 | −425 | −2068 | −749 | 2814 | −3898 | −702 | −1624 | −3788 | −4192 | −3522 | −3699 | 766 | −2535 | 1640 | −2881 | −2539 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2839 | −10161 | −219 | −894 | −1115 | −701 | −1378 | * | * | | | | | | | | | | | | |
| 93 | −1873 | −2460 | −1604 | −1767 | −2864 | 2423 | 4327 | −3662 | −1985 | −3637 | −3006 | −1843 | −2869 | −1979 | −2202 | −1952 | −2121 | −3092 | −3013 | −2426 | 111 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −13 | −7336 | −8378 | −894 | −1115 | −28 | −5677 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 94 | −1619 | 385 | −5411 | −5204 | −5129 | −1378 | −4739 | −4788 | −5020 | −5076 | 1107 | 3570 | −4706 | −4732 | −5057 | 2052 | −3433 | −4189 | −5468 | −1313 | 112 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 95 | 1184 | −2425 | −4868 | −4237 | −2381 | 212 | −2998 | 847 | −3847 | 318 | −499 | −3754 | −4180 | 581 | −3671 | −829 | 1537 | 1650 | −2883 | −2539 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 96 | 1668 | −3756 | −5768 | −5688 | −6085 | 2006 | −5244 | −1711 | −5502 | −6085 | −5170 | −752 | −1668 | −5166 | −5489 | 1874 | 1355 | −4784 | −6300 | −6114 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −10161 | −11203 | −894 | −1115 | −701 | −1378 | * | * | | | | | | | | | | | | |
| 97 | 955 | 3255 | −4885 | −1292 | −1167 | −386 | −2998 | 327 | −3858 | 958 | 966 | 798 | −4179 | −3489 | −3674 | −816 | 168 | 382 | −2877 | −2533 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −10161 | −11203 | −894 | −1115 | −701 | −1378 | * | * | | | | | | | | | | | | |
| 98 | −1126 | −3767 | 1820 | −459 | 564 | −3328 | −254 | −1741 | −585 | 422 | 454 | 1659 | −915 | 665 | 822 | −686 | −2285 | −1231 | 592 | −3294 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −10161 | −11203 | −894 | −1115 | −701 | −1378 | * | * | | | | | | | | | | | | |
| 99 | −242 | −3801 | 1453 | 411 | −4115 | −530 | −335 | −1698 | −1561 | −1951 | −353 | 661 | 1449 | −110 | −2067 | 714 | 1198 | −458 | −3988 | −3309 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2 | −10161 | −11203 | −894 | −1115 | −701 | −1378 | * | * | | | | | | | | | | | | |
| 100 | 177 | −3696 | −2254 | 991 | −382 | −1465 | 1138 | −3679 | −1616 | −1817 | −2799 | 1580 | −1605 | −560 | −2113 | 1844 | 334 | −390 | −3911 | 460 | 118 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −2 | −10161 | −11203 | −894 | −1115 | −701 | −1378 | * | * | | | | | | | | | | | | |
| 101 | −2589 | −2416 | −4927 | −4291 | 2303 | −4135 | 2164 | −344 | −3888 | 1711 | −65 | −3779 | −4185 | 220 | 232 | −3220 | −1148 | −374 | 751 | 1281 | 119 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 102 | −1055 | −3713 | 96 | −1695 | 1719 | −3343 | −2007 | −3708 | −1607 | −3709 | −2814 | 2208 | 253 | 1163 | −698 | 314 | 1049 | −99 | −3924 | 486 | 120 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 103 | −1243 | −2904 | −5466 | −4837 | 3755 | −4702 | 1425 | 1082 | −4447 | 214 | 230 | −4349 | −4697 | −4022 | −4234 | −3799 | −3049 | −59 | −3342 | −3037 | 121 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 104 | 575 | −3069 | −2812 | −1307 | 249 | −499 | −2315 | −1307 | 285 | −480 | −119 | −2458 | −3680 | −244 | 1622 | 1647 | −57 | −1145 | 1898 | −2938 | 122 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 105 | −5036 | −4486 | −7597 | −7147 | 1021 | −7409 | −6623 | 3507 | −7027 | 283 | −235 | −7092 | −6773 | −6229 | −6788 | −6777 | −4964 | 901 | −5372 | −5408 | 123 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 106 | 1225 | −3829 | 1962 | 1462 | −4147 | 239 | 747 | −3897 | −1574 | −2327 | −2919 | −1963 | −549 | 1850 | −2082 | −1536 | −2298 | −1025 | −4013 | −3330 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 107 | −4650 | −6623 | 1027 | −2603 | −6910 | 3066 | −3895 | −6921 | −4361 | −6750 | −6207 | 2387 | −5002 | 47 | −5405 | −2412 | −4779 | −6315 | −6956 | −5800 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 108 | −5611 | −5798 | −5027 | −5012 | −3537 | −5801 | 5339 | −5998 | −3838 | −1363 | −5249 | −4902 | −6091 | −573 | −3843 | −5530 | −5606 | −6031 | −4109 | −3075 | 126 |
| — | −149 | −500 | 233 | 43 | −381 | 399 | 106 | −626 | 210 | −466 | −720 | 275 | 394 | 48 | 96 | 359 | 117 | −369 | −294 | −249 | |
| C | −216 | −5403 | −3117 | −203 | −2928 | −701 | −1378 | * | * | | | | | | | | | | | | |
| 109 | −2194 | −3667 | −581 | 783 | −3988 | −3168 | −1826 | −1935 | 1452 | −3683 | −768 | 1842 | −790 | 698 | 501 | 1009 | 1254 | −3289 | −3850 | −3168 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2 | −9985 | −11027 | −894 | −1115 | −2508 | −279 | * | * | | | | | | | | | | | | |
| 110 | −5717 | −5049 | −8079 | −7472 | 1395 | −7951 | −6461 | 45 | −7290 | 2012 | 4229 | −7693 | −6778 | −5887 | −6681 | −7384 | −5527 | −3386 | −4833 | −5099 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9985 | −11027 | −894 | −1115 | −2508 | −279 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 111 | −2237 | −3463 | −2193 | −1058 | −3694 | −3251 | −1916 | −1824 | 914 | −1145 | −2578 | −1099 | −3340 | 112 | −848 | −207 | 3202 | −232 | −3701 | −3083 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9985 | −11027 | −894 | −1115 | −2508 | −279 | * | * | | | | | | | | | | | | |
| 112 | −4505 | −3973 | −7160 | −6805 | −1044 | −7019 | −6754 | 2180 | −6756 | 862 | −2664 | −6680 | −6600 | −6390 | −6773 | −6405 | −4476 | 3033 | −5753 | −5523 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9985 | −11027 | −894 | −1115 | −2508 | −279 | * | * | | | | | | | | | | | | |
| 113 | −2178 | −3733 | −6932 | −6614 | −4474 | −6753 | −6782 | 2737 | −6579 | −3253 | −261 | −6418 | −6510 | −6552 | −6752 | −6124 | −1040 | 3034 | −6199 | −5657 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9985 | −11027 | −894 | −1115 | −2508 | −279 | * | * | | | | | | | | | | | | |
| 114 | 383 | −5402 | −2092 | 3552 | −5842 | −889 | 290 | −5693 | −3279 | −5599 | −4826 | −2670 | −4472 | −435 | −3960 | −1673 | −3847 | −5163 | −5780 | −4908 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9985 | −11027 | −894 | −1115 | −2508 | −279 | * | * | | | | | | | | | | | | |
| 115 | 2087 | −2519 | −5081 | −4468 | −2543 | −4316 | −3241 | −159 | −4085 | −1543 | 1121 | −3970 | −4360 | −3723 | −3904 | −488 | 390 | 2526 | −3101 | −2753 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5149 | −9985 | −43 | −894 | −1115 | −1039 | −962 | * | * | | | | | | | | | | | | |
| 116 | −1423 | −1686 | −2052 | −2290 | −3178 | 3569 | −2293 | −3362 | −2572 | −3429 | −2897 | −2066 | −2362 | −2411 | −2558 | −1639 | −1785 | −2703 | −2768 | −3024 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −25 | −6448 | −7490 | −894 | −1115 | −4521 | −64 | * | * | | | | | | | | | | | | |
| 117 | −1278 | −2546 | 3281 | 127 | −3255 | 1131 | −899 | −3188 | −1093 | −3157 | −2472 | −220 | −1937 | −596 | −1807 | −1089 | −1412 | −2640 | −3189 | −2473 | 136 |
| — | −149 | −500 | 234 | 43 | −381 | 398 | 105 | −627 | 210 | −465 | −721 | 275 | 393 | 45 | 96 | 359 | 117 | −370 | −284 | −245 | |
| E | −1855 | −476 | −7733 | −337 | −2262 | −5079 | −43 | * | * | | | | | | | | | | | | |
| 118 | −1313 | −1184 | −3200 | −3080 | −1531 | −2616 | −2626 | 763 | −2836 | −685 | −588 | −2690 | −2948 | −2749 | −2831 | −2115 | −1448 | 3353 | −2550 | −2123 | 139 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −21 | −6691 | −7733 | −894 | −1115 | −5079 | −43 | * | * | | | | | | | | | | | | |
| 119 | −3270 | −2624 | −3539 | −3684 | −917 | −2942 | −1919 | −3105 | −3277 | −2706 | −2658 | −3264 | −3308 | −3199 | −3032 | −3496 | −3381 | −3147 | 6087 | −529 | 140 |
| — | −148 | −500 | 233 | 46 | −381 | 398 | 105 | −626 | 210 | −466 | −721 | 275 | 394 | 45 | 96 | 359 | 118 | −370 | −295 | −250 | |
| E | −1855 | −476 | −7733 | −85 | −4126 | −67 | −4470 | * | * | | | | | | | | | | | | |
| 120 | −4653 | −6702 | 3689 | 1449 | −6894 | −1455 | −3856 | −6911 | −4333 | −6733 | −6202 | −2960 | −4973 | −3556 | −5397 | −4255 | 666 | −6318 | −6939 | −5770 | 142 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10124 | −11166 | −894 | −1115 | −1336 | −727 | * | * | | | | | | | | | | | | |
| 121 | 1019 | −3367 | −5886 | −5693 | 1039 | 3266 | −4565 | −3889 | −5335 | −2195 | −434 | −4533 | −4688 | −4909 | −5105 | −986 | −3324 | −3558 | −4706 | −4354 | 143 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10124 | −11166 | −894 | −1115 | −1336 | −727 | * | * | | | | | | | | | | | | |
| 122 | −1049 | −761 | −2314 | 209 | −1208 | −1373 | 846 | −532 | 322 | −1619 | −2640 | 837 | −3451 | 610 | −1367 | 307 | 968 | 1901 | −3773 | −420 | 144 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10124 | −11166 | −894 | −1115 | −411 | −2014 | * | * | | | | | | | | | | | | |
| 123 | −1098 | −2604 | −3874 | −643 | 1144 | −3945 | 2283 | −2136 | −3069 | −1784 | −1797 | 1611 | 1212 | −2866 | −3212 | −2974 | −1239 | −770 | 695 | 3251 | 145 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 124 | −835 | −2433 | −4773 | −4147 | −2389 | −2123 | 1852 | 318 | −3776 | −795 | −1635 | −1573 | −4164 | −3428 | −953 | −1685 | 2287 | 2333 | 801 | −2543 | 146 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 125 | −1004 | −3810 | 327 | 1243 | −4128 | −3316 | 411 | −459 | 1423 | −827 | −2899 | 1156 | −3409 | 1713 | −2063 | −1499 | 343 | 569 | −3994 | −3313 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2443 | −10161 | −295 | −894 | −1115 | −701 | −1378 | * | * | | | | | | | | | | | | |
| 126 | 1314 | −2160 | −577 | −86 | −2483 | −1724 | 2041 | −2208 | 1107 | −2184 | −1290 | 1280 | 1313 | 33 | −439 | −679 | −729 | −1793 | −2374 | −1723 | 148 |
| — | −149 | −500 | 232 | 43 | −381 | 398 | 105 | −627 | 212 | −466 | −721 | 275 | 398 | 45 | 95 | 359 | 117 | −370 | −295 | −246 | |
| . | −1957 | −730 | −2840 | −51 | −4841 | −30 | −5605 | * | * | | | | | | | | | | | | |
| 127 | −1302 | −5099 | −1106 | −662 | −5372 | −3934 | −2942 | −5179 | −597 | −5095 | −4248 | −499 | 3621 | 2130 | −3386 | −1698 | −3455 | −4704 | −5269 | −4469 | 150 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10124 | −11166 | −894 | −1115 | −1336 | −727 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 128 | 6 | −2537 | −3948 | −1281 | 2304 | −3932 | 2 | −592 | −3124 | 670 | −1731 | 1163 | −3993 | 238 | −854 | −1711 | 133 | 396 | −2973 | 1782 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10124 | −11166 | −894 | −1115 | −411 | −2014 | * | * | | | | | | | | | | | | |
| 129 | −1626 | −3805 | 445 | 798 | −1292 | −1918 | −1977 | −668 | −178 | −2659 | 213 | 856 | −1480 | 376 | 509 | 435 | 1802 | 363 | −3991 | −1303 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 130 | −932 | −2418 | −1362 | −4282 | −198 | −4135 | −3005 | −601 | −3881 | −794 | 194 | −3775 | −4185 | −89 | −3687 | −3219 | 1977 | 2506 | −2875 | 1834 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 131 | −1145 | −4182 | 3149 | 971 | −4493 | −3526 | −2274 | −4255 | −92 | −4194 | −3283 | 698 | −3680 | −169 | −2441 | 91 | 553 | −3800 | −4363 | −3656 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −10161 | −11203 | −894 | −1115 | −701 | −1378 | * | * | | | | | | | | | | | | |
| 132 | −593 | −3799 | 582 | −136 | −4113 | −2190 | −1978 | −1461 | −638 | −2209 | −494 | 418 | −3412 | −754 | 135 | 2204 | 1237 | −107 | −3986 | −876 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −2 | −10161 | −11203 | −894 | −1115 | −701 | −1378 | * | * | | | | | | | | | | | | |
| 133 | −5292 | −4775 | −7677 | −7080 | 214 | −7299 | −6020 | 2681 | −6830 | 2143 | −429 | −6993 | −6586 | −5781 | −6392 | −6569 | −5158 | 351 | 2302 | −4944 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 134 | −2361 | −3620 | 2006 | −315 | 1694 | −3371 | −34 | −3554 | −1659 | −222 | 926 | 147 | −2131 | 1982 | 191 | −2286 | −1523 | −352 | −3855 | 492 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 135 | −4625 | −4091 | −7303 | −6971 | −4267 | −7185 | −7093 | 3366 | −6945 | 1134 | −2969 | −6846 | −6795 | −6682 | −7026 | −6587 | −4604 | 1524 | −6123 | −5826 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 136 | 776 | −2773 | −3358 | −2790 | 1912 | 852 | 2622 | −2351 | −2625 | −2652 | −1959 | −2866 | −969 | −2486 | −337 | 203 | 285 | −1134 | −3183 | 2060 | 159 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2 | −10161 | −11203 | −894 | −1115 | −701 | −1378 | * | * | | | | | | | | | | | | |
| 137 | 1314 | −2444 | −4873 | −4247 | −2408 | −176 | −3019 | −286 | −3860 | −1646 | 983 | −3764 | 2004 | −3498 | −3688 | 651 | −557 | 1862 | −2910 | −2566 | 160 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 138 | 1500 | −3853 | −6388 | −6736 | −6494 | 3429 | −5851 | −1140 | −6501 | −6548 | −5635 | −4943 | −4946 | −5951 | −6135 | −3510 | −3730 | −4982 | −6715 | −6691 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 139 | −2046 | −4957 | −2649 | 1314 | −6176 | −4188 | −3771 | −6013 | −3767 | −5971 | −5181 | −3158 | −4734 | 4085 | −4339 | −410 | −125 | −5303 | −6135 | −5381 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 140 | −110 | 1087 | −4668 | −4136 | −537 | −4033 | −3385 | −2677 | −3825 | −1417 | −2344 | −3776 | −4318 | −3592 | 2914 | 1008 | 2074 | −2528 | −3582 | −3229 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 141 | −1726 | −2424 | −4942 | −4306 | 1317 | −449 | −3017 | −951 | −3902 | −794 | 1802 | −3791 | −4195 | −3524 | −3702 | −3231 | 831 | −625 | −2881 | 3900 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 142 | −191 | −5347 | 2048 | −997 | −5781 | −1180 | −3280 | −5617 | −3244 | −5533 | −4722 | 1274 | −4509 | −2901 | −3916 | 2641 | 163 | −5094 | −5715 | −4870 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 143 | 1102 | −3655 | −6649 | −6209 | 1956 | −6223 | −5602 | 943 | −6013 | −2145 | −2990 | −5878 | −6100 | −5802 | −5996 | −5457 | −1993 | 2994 | −5279 | −4857 | 166 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 144 | −2868 | −2679 | −5216 | −4582 | −1090 | −4433 | −3302 | 1331 | −4183 | 2421 | 775 | −4081 | −4456 | −640 | −3976 | −3523 | −673 | 1338 | −3121 | −219 | 167 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 145 | −3348 | −3112 | −5720 | −5104 | −117 | −4987 | −3877 | 1319 | −4728 | 1750 | 336 | −4636 | −4954 | −4293 | −4519 | −4094 | −971 | 2435 | −3613 | 956 | 168 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 146 | −2343 | −3807 | 192 | 455 | −1344 | −3318 | 947 | −3873 | 1372 | −1732 | −2897 | 957 | −3411 | −1518 | −1271 | −1701 | 2798 | −1243 | −3993 | −3312 | 169 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 147 | 2920 | −2592 | −5031 | −4443 | 657 | −2068 | −3226 | −2172 | −4058 | −656 | 1189 | −3893 | −556 | −3690 | −3882 | −3253 | 1248 | −2078 | −3135 | −2795 | 170 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2116 | −10161 | −380 | −894 | −1115 | −701 | −1378 | * | * | | | | | | | | | | | | |
| 148 | −1297 | −2825 | 2043 | −308 | −3129 | −2020 | 971 | −2898 | 2217 | −2830 | −1941 | 1749 | −2232 | −414 | −1052 | −121 | −1255 | −2442 | −2998 | −2274 | 171 |
| — | −149 | −500 | 233 | 45 | −381 | 398 | 105 | −626 | 210 | −466 | −721 | 275 | 394 | 45 | 96 | 359 | 119 | −369 | −295 | −249 | |
| . | −158 | −3296 | −9096 | −982 | −1018 | −32 | −5524 | * | * | | | | | | | | | | | | |
| 149 | −1123 | −3814 | 1792 | −678 | −4135 | −3315 | −1974 | −3885 | 1252 | −2347 | 607 | 2492 | −350 | 1611 | −2062 | −748 | −602 | −2352 | −3997 | −3315 | 174 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −152 | −10161 | −3331 | −894 | −1115 | −701 | −1378 | * | * | | | | | | | | | | | | |
| 150 | 265 | −3689 | 75 | −552 | −4010 | −608 | −551 | −2107 | −1 | −3705 | −2778 | 886 | −1722 | 3536 | −1170 | −1180 | −2155 | −3311 | −3872 | −508 | 175 |
| — | −149 | −500 | 234 | 42 | −381 | 398 | 105 | −627 | 210 | −464 | −716 | 277 | 393 | 45 | 95 | 360 | 117 | −370 | −295 | −245 | |
| S | −711 | −2344 | −2381 | −33 | −5472 | −188 | −3034 | * | * | | | | | | | | | | | | |
| 151 | 1248 | −3588 | 1142 | −87 | −3908 | −1823 | −1748 | −3659 | −729 | −3604 | −2677 | −214 | 2025 | −1289 | −359 | 123 | 1472 | −1497 | −3772 | −3089 | 177 |
| — | −150 | −501 | 232 | 44 | −382 | 399 | 105 | −627 | 209 | −467 | −721 | 274 | 399 | 47 | 97 | 359 | 119 | −370 | −295 | −250 | |
| S | −270 | −2555 | −10930 | −705 | −1372 | −447 | −1908 | * | * | | | | | | | | | | | | |
| 152 | 119 | −3632 | 945 | −1662 | −3895 | −996 | −1967 | 197 | −990 | −1643 | −2737 | −263 | 1709 | −471 | −209 | 99 | 326 | 1589 | −3851 | −3205 | 181 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −10102 | −11144 | −894 | −1115 | −330 | −2291 | * | * | | | | | | | | | | | | |
| 153 | −286 | −3817 | 1474 | −506 | −4138 | 1930 | −603 | −3889 | 1071 | −3833 | −2906 | −525 | −3410 | 958 | 1111 | −101 | −1170 | −3439 | −4000 | −3317 | 182 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 154 | −782 | −3811 | 1290 | −598 | −4130 | −3316 | −1975 | −1119 | −217 | −3826 | −2900 | 3184 | −3409 | −177 | −20 | −629 | 202 | −458 | −3995 | −878 | 183 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 155 | −6831 | −5737 | −7191 | −7554 | 1905 | −7076 | −757 | −5713 | −7109 | −5014 | −5113 | −5680 | −6929 | −5822 | −6467 | −6325 | −6678 | −5870 | 1123 | 4634 | 184 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 156 | 830 | −2420 | −1878 | −4255 | 681 | −4129 | −2998 | −1912 | −3860 | −543 | 772 | −3761 | −1073 | −3491 | −3675 | −988 | −510 | −1006 | 4671 | 2544 | 185 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 157 | −2049 | −3183 | −5807 | −5196 | 263 | −5086 | −3982 | 2982 | −4826 | 264 | 2826 | −4735 | −5042 | −4387 | −4618 | −4198 | −3366 | 766 | −3702 | 955 | 186 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 158 | 463 | −2542 | −4104 | −3512 | 745 | −3992 | −66 | −2061 | −3258 | −993 | 1089 | −4 | −4052 | −689 | 1918 | 598 | 110 | 1674 | 701 | −2615 | 187 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 159 | 2648 | 1499 | −1327 | −3913 | −560 | −4073 | −2923 | −17 | −3590 | −2319 | −13 | 207 | −4127 | −277 | −3528 | −1223 | −748 | 1200 | −2918 | −2565 | 188 |
| — | −149 | −500 | 232 | 43 | −381 | 400 | 105 | −625 | 211 | −465 | −721 | 275 | 393 | 45 | 95 | 360 | 117 | −370 | −295 | −247 | |
| E | −2515 | −3001 | −514 | −46 | −4993 | −701 | −1378 | * | * | | | | | | | | | | | | |
| 160 | −293 | −1268 | −41 | −1779 | 387 | −2534 | −1328 | −86 | −1574 | −517 | 2644 | 2236 | −2598 | 49 | −1757 | −382 | −1099 | 227 | 2018 | −1308 | 190 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −6 | −8426 | −9468 | −894 | −1115 | −3642 | −120 | * | * | | | | | | | | | | | | |
| 161 | −2818 | −4486 | 2377 | −1101 | −4984 | −2814 | −2243 | −4906 | −2487 | −4796 | −4121 | −1479 | 3341 | 738 | −3308 | −541 | −2929 | −4326 | −4986 | −4003 | 191 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −6 | −8570 | −9612 | −894 | −1115 | −4659 | −58 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 162 | −1151 | −2487 | 102 | 870 | −894 | −982 | −812 | −2467 | −417 | −2480 | 1556 | 2306 | −2239 | −372 | −914 | 751 | 783 | −191 | −2704 | −2056 | 192 |
| — | −149 | −500 | 232 | 42 | −381 | 399 | 105 | −626 | 210 | −467 | −721 | 276 | 393 | 45 | 96 | 360 | 123 | −370 | −295 | −250 | |
| C | −912 | −1097 | −9612 | −37 | −5287 | −4659 | −58 | * | * | | | | | | | | | | | | |
| 163 | 642 | −1167 | −3334 | −2717 | 1252 | 290 | −1658 | 21 | −703 | 234 | 2848 | −549 | −2856 | −2055 | −2283 | −691 | 311 | 701 | −1619 | −1270 | 194 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −6 | −8570 | −9612 | −894 | −1115 | −4659 | −58 | * | * | | | | | | | | | | | | |
| 164 | −239 | 1631 | −3598 | −2965 | 583 | 2268 | −1712 | 30 | −2571 | 715 | 1460 | −644 | −2893 | −2203 | −2388 | −1926 | −1241 | 130 | −1591 | −1248 | 195 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2842 | −8570 | −221 | −894 | −1115 | −1635 | −561 | * | * | | | | | | | | | | | | |
| 165 | −216 | −1994 | −971 | −422 | 559 | 304 | 1245 | −1865 | −320 | −1978 | −1150 | −693 | −2060 | −268 | 1478 | 1209 | 1312 | −1563 | −2294 | −1709 | 196 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −8 | −8157 | −9200 | −894 | −1115 | −2128 | −375 | * | * | | | | | | | | | | | | |
| 166 | 185 | −2461 | −4597 | −4663 | 2000 | −2801 | −3982 | −4215 | −4501 | −4484 | −3664 | −3412 | 2646 | −4086 | −4357 | 2405 | −2318 | −3352 | −4643 | −4282 | 197 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | −8851 | −9893 | −894 | −1115 | −4506 | −65 | * | * | | | | | | | | | | | | |
| 167 | −47 | −1805 | −3296 | −2786 | 1548 | 601 | −2166 | −1612 | −2559 | −1937 | −1263 | −2522 | −3154 | −2326 | −2656 | 1111 | 1334 | −1456 | −2427 | 3021 | 198 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | −8851 | −9893 | −894 | −1115 | −1279 | −766 | * | * | | | | | | | | | | | | |
| 168 | −499 | −3290 | −782 | −307 | 104 | 311 | 575 | −3361 | −355 | −3306 | 1054 | 731 | −1188 | 645 | 1967 | 365 | 1081 | −2912 | −3473 | −2791 | 199 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −3 | −9517 | −10559 | −894 | −1115 | −1106 | −901 | * | * | | | | | | | | | | | | |
| 169 | −1197 | −2853 | 293 | −1913 | 1906 | 800 | 1684 | −1342 | −1796 | −2764 | −516 | 658 | −92 | −1717 | −2211 | 895 | 1103 | −624 | −3198 | −274 | 200 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −9840 | −10882 | −894 | −1115 | −529 | −1704 | * | * | | | | | | | | | | | | |
| 170 | 408 | 216 | 849 | −612 | −4024 | 1467 | 351 | −961 | −773 | −804 | −2808 | 950 | −3343 | −109 | −695 | −851 | 686 | 663 | −3906 | −3231 | 201 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −445 | −10076 | −1918 | −894 | −1115 | −1875 | −459 | * | * | | | | | | | | | | | | |
| 171 | 57 | −3225 | −460 | −1291 | −937 | −2924 | −1591 | −692 | 940 | 292 | −2332 | 957 | −997 | −251 | 1426 | −250 | 1040 | 281 | −3450 | −2810 | 202 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −3 | −9633 | −10675 | −894 | −1115 | −947 | −1055 | * | * | | | | | | | | | | | | |
| 172 | −382 | 1460 | −2092 | −44 | −3679 | 114 | −1835 | 1322 | 202 | −498 | −792 | 1372 | 506 | 825 | −536 | −60 | −1215 | −286 | −3666 | −3033 | 203 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −9923 | −10965 | −894 | −1115 | −2808 | −222 | * | * | | | | | | | | | | | | |
| 173 | 792 | −3609 | −27 | 805 | −3927 | 591 | −1777 | −293 | −682 | −3624 | −2699 | −249 | 1377 | −1318 | 1062 | −290 | −646 | 721 | −3794 | −3113 | 204 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −9923 | −10965 | −894 | −1115 | −2808 | −222 | * | * | | | | | | | | | | | | |
| 174 | 1266 | −3601 | 340 | 304 | −3915 | −3120 | 1582 | −1064 | 739 | 218 | −215 | −46 | 659 | −1322 | −511 | 18 | −80 | −1008 | −3788 | −3110 | 205 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −285 | −9923 | −2487 | −894 | −1115 | −135 | −3485 | * | * | | | | | | | | | | | | |
| 175 | −809 | −2859 | 113 | −989 | 2835 | −14 | −2121 | −1541 | −1945 | −414 | −439 | −664 | 940 | −148 | −1097 | −268 | −1384 | 355 | 998 | −2732 | 206 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −2 | −9925 | −10968 | −894 | −1115 | −2799 | −224 | * | * | | | | | | | | | | | | |
| 176 | 290 | −3616 | 1775 | 666 | −805 | −1127 | 996 | −1224 | 658 | −415 | −2705 | 742 | −1227 | 168 | 194 | −1330 | 136 | −1955 | −3800 | −511 | 207 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −9925 | −10968 | −894 | −1115 | −2799 | −224 | * | * | | | | | | | | | | | | |
| 177 | −856 | −3585 | −487 | −1460 | −3892 | 618 | −1787 | −1507 | −704 | −733 | −2678 | 2842 | −289 | 658 | −473 | −1509 | 1288 | −1162 | −3777 | −3104 | 208 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −9925 | −10968 | −894 | −1115 | −2799 | −224 | * | * | | | | | | | | | | | | |
| 178 | −440 | −63 | −3181 | −2613 | −2559 | 2105 | −179 | −2123 | −2445 | −889 | −1736 | −701 | 1494 | −1021 | −2717 | −528 | 1302 | 512 | −2961 | −177 | 209 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −9925 | −10968 | −894 | −1115 | −136 | −3476 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 179 | −128 | −2600 | −3858 | −3275 | −2581 | −3935 | −400 | 577 | −3054 | 224 | 738 | 1559 | −21 | 150 | −504 | −618 | 1929 | −222 | −3032 | 960 | 210 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −10161 | −11203 | −894 | −1115 | −701 | −1378 | * | * | | | | | | | | | | | | |
| 180 | 1331 | −3746 | −2226 | −614 | −4036 | 419 | −1996 | −244 | −672 | −3749 | −2844 | 1728 | −170 | 303 | −2092 | −1441 | 1864 | −3 | −3948 | −3285 | 211 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 181 | 1182 | −2422 | −4868 | −4237 | −925 | −2263 | −2995 | −102 | −3846 | 187 | −1624 | −3752 | −4177 | −3480 | 376 | 1321 | 2044 | 445 | −2878 | −319 | 212 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 182 | 2583 | −2717 | −3482 | −2911 | −521 | 1468 | 1137 | −1109 | −2733 | −1837 | −1904 | −1190 | −3902 | −1248 | −2981 | −611 | 50 | −2159 | −3133 | −243 | 213 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 183 | −1721 | −2415 | −4931 | −4295 | 697 | −4135 | −3006 | 2763 | −3891 | −41 | −1617 | −1233 | −4185 | −1122 | −3691 | −2042 | 579 | 1505 | 1592 | 84 | 214 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 184 | −2827 | −2644 | −5159 | −4524 | 1035 | −4385 | −3251 | 1198 | 30 | 2613 | 651 | −4027 | −4411 | −637 | −3921 | −2086 | −2765 | −1299 | −3079 | −2759 | 215 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 185 | −797 | −3864 | −2262 | −778 | −4189 | −3378 | 2716 | −3931 | −980 | −3874 | −2955 | 894 | −3470 | 900 | 2592 | −253 | −2346 | 1271 | −4038 | −3370 | 216 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 186 | −4233 | −5697 | −578 | −90 | −5621 | −4306 | −3592 | −5615 | −3796 | −5655 | −4991 | −2933 | −4804 | −496 | −4530 | −3978 | −589 | −912 | −5820 | 4590 | 217 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −10161 | −11203 | −894 | −1115 | −701 | −1378 | * | * | | | | | | | | | | | | |
| 187 | −490 | −3814 | 660 | 399 | −4134 | 668 | −219 | −390 | 521 | −1352 | −2903 | 817 | −3408 | 1118 | −318 | 1096 | −543 | −568 | −3997 | −245 | 218 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −10161 | −11203 | −894 | −1115 | −701 | −1378 | * | * | | | | | | | | | | | | |
| 188 | −1123 | 1381 | −2189 | 1074 | −4135 | 2271 | 709 | −3886 | 320 | −3830 | −2904 | 1339 | 465 | −747 | −1303 | −451 | −995 | −3436 | −3998 | −3315 | 219 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −2 | −10161 | −11203 | −894 | −1115 | −701 | −1378 | * | * | | | | | | | | | | | | |
| 189 | 2118 | −3734 | −944 | −1708 | −4028 | 170 | −694 | −3751 | −1623 | −2494 | −2847 | 1159 | 368 | −1579 | −2124 | 1377 | −365 | −3345 | 2139 | −3297 | 220 |
| — | * | * | * | * | * | * | * | * | * | * | * | * | * | * | * | * | * | * | * | * | |
| T | * | * | * | * | * | * | * | * | 0 | | | | | | | | | | | | |
| // | | | | | | | | | | | | | | | | | | | | | |

```
HMMER2.0  [2.3.2]
NAME      Cu-oxidase_2
ACC       PF07731.6
DESC      Multicopper oxidase
LENG      154
ALPH      Amino
RF        no
CS        yes
MAP       yes
COM       hmmbuild -F HMM_ls.ann SEED.ann
COM       hmmcalibrate --seed 0 HMM_ls.ann
NSEQ      127
DATE      Wed Apr 23 01:56:48 2008
CKSUM     810
GA        -5.8000 -5.8000;
TC        -5.2000 -5.2000;
NC        -6.0000 -6.0000;
XT        -8455  -4  -1000  -1000  -8455  -4  -8455  -4
NULT      -4  -8455
NULE      595  -1558  85  338  -294  453  -1158  197  249  902  -1085  -142  -21  -313  45  531  201  384  -1998  -644
EVD       -72.886528  0.222053
HMM       A      C      D      E      F      G      H      I      K      L      M      N      P      Q      R      S      T      V      W      Y
          m->m   m->i   m->d   i->m   i->i   d->m   d->d   b->m   m->e
          -18    *      -6340
1         -2561  -5000  1601   540    818    -1256  431    -5071  -1583  -1368  -4089  380    845    -32    699    -448   -46    -4622  184    2209   1
—         -149   -500   233    43     -381   399    106    -626   210    -466   -720   275    394    45     96     359    117    -369   -294   -249
B         -1     -11488 -12530 -894   -1115  -701   -1378  -18    *
2         -905   -4564  -1340  -1173  1454   -2493  -805   882    -604   -549   341    -1068  753    -1635  786    -2062  1574   981    -4858  -1575  2
—         -149   -500   233    43     -381   399    106    -626   210    -466   -720   275    394    45     96     359    117    -369   -294   -249
—         -1     -11488 -12530 -894   -1115  -701   -1378  *      *
3         201    -4999  1078   -381   -2135  -751   -738   -5070  -2740  -1641  -4088  1169   2526   -271   -1129  879    54     -2703  -5182  -4500  3
—         -149   -500   233    43     -381   399    106    -626   210    -466   -720   275    394    45     96     359    117    -369   -294   -249
S         -1     -11488 -12530 -894   -1115  -701   -1378  *      *
4         -525   -506   -480   -1047  -419   -2494  -1073  -1521  -1976  779    1226   -1377  2601   -925   -896   -1817  -684   -724   2750   -854   4
—         -149   -500   233    43     -381   399    106    -626   210    -466   -720   275    394    45     96     359    117    -369   -294   -249
—         -1     -11488 -12530 -894   -1115  -701   -1378  *      *
5         -818   -4999  837    -1009  -2301  -1456  -3159  -2465  1834   -2966  -1092  880    1026   290    706    455    557    -2099  -5183  59     5
—         -149   -500   233    43     -381   399    106    -626   210    -466   -720   275    394    45     96     359    117    -369   -294   -249
S         -12    -11488 -7014  -894   -1115  -701   -1378  *      *
6         -317   -4974  -117   -742   -5288  109    -172   -781   -360   370    644    -122   1426   -802   273    -396   -124   1098   -5162  -1290  6
—         -149   -500   233    43     -381   399    106    -626   210    -466   -720   275    394    45     96     359    117    -369   -294   -249
C         -1     -11477 -12519 -894   -1115  -1199  -825   *      *
7         608    -4822  -738   253    -5070  -4542  -880   -1046  -2823  -1973  278    -1583  3228   -678   -1225  -514   -1694  27     -5051  -1280  7
—         -149   -500   233    43     -381   399    106    -626   210    -466   -720   275    394    45     96     359    117    -369   -294   -249
G         -1     -11477 -12519 -894   -1115  -1199  -825   *      *
8         -1361  -546   730    -1205  -1150  -926   -1619  668    -613   428    -3929  -1126  502    -375   -2136  -476   1687   1226   -5049  -4414  8
—         -149   -500   233    43     -381   399    106    -626   210    -466   -720   275    394    45     96     359    117    -369   -294   -249
H         -1     -11477 -12519 -894   -1115  -1199  -825   *      *
```

-continued

| | | | | | | | | | | | | | | | | | | | | | |
|---|---|---|---|---|---|---|---|---|---|---|---|---|---|---|---|---|---|---|---|---|---|
| 9 | −1717 | −4638 | −1863 | −261 | −1321 | −2682 | 260 | −423 | 72 | 1905 | 304 | −1132 | 385 | −113 | 134 | −1260 | −2197 | 625 | −771 | 378 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11477 | −12519 | −894 | −1115 | −1199 | −825 | * | * | | | | | | | | | | | | |
| 10 | −778 | −4631 | −958 | −822 | 2072 | −795 | 635 | −82 | −1370 | 1134 | 957 | −628 | 371 | 76 | −2020 | −1132 | −1106 | −933 | −4907 | 1251 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11477 | −12519 | −894 | −1115 | −1199 | −825 | * | * | | | | | | | | | | | | |
| 11 | −1544 | −4989 | 1169 | −326 | −5310 | −954 | 1078 | −2513 | 622 | −1207 | 187 | 1004 | −4584 | 2233 | −433 | −941 | 1082 | −1713 | −5173 | 688 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11477 | −12519 | −894 | −1115 | −1199 | −825 | * | * | | | | | | | | | | | | |
| 12 | 84 | −3630 | −6117 | −2659 | 335 | −1667 | −1020 | 1769 | −1924 | 954 | 1169 | −4981 | −2499 | −4712 | −279 | −1255 | 12 | 1075 | −4087 | 1619 | 12 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1508 | −11477 | −626 | −894 | −1115 | −1199 | −825 | * | * | | | | | | | | | | | | |
| 13 | −2188 | −3600 | −299 | −1510 | −625 | 135 | 1286 | 714 | 225 | −3606 | −9 | −473 | −512 | −1380 | 1147 | −265 | 2371 | −3209 | −3799 | −3131 | 13 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9971 | −11013 | −894 | −1115 | −5890 | −25 | * | * | | | | | | | | | | | | |
| 14 | −886 | −3495 | 782 | −1571 | −3747 | 2012 | −1869 | −3451 | −1481 | −632 | 1460 | 959 | −902 | 640 | −1975 | −240 | 1060 | −1022 | −3722 | −3083 | 14 |
| — | −149 | −492 | 235 | 39 | −372 | 396 | 114 | −630 | 207 | −466 | −724 | 281 | 390 | 46 | 94 | 360 | 122 | −371 | −298 | −245 | |
| E | −5135 | −42 | −11013 | −7 | −7683 | −5890 | −25 | * | * | | | | | | | | | | | | |
| 15 | −116 | −3604 | −705 | −590 | −3901 | −372 | 1033 | 743 | −1421 | −3610 | 3227 | 480 | 153 | 776 | −443 | −912 | −32 | 339 | −3801 | −3133 | 16 |
| — | −147 | −504 | 243 | 45 | −380 | 399 | 102 | −630 | 207 | −464 | −711 | 272 | 391 | 41 | 101 | 359 | 115 | −371 | −298 | −253 | |
| E | −5135 | −42 | −11013 | −7 | −7683 | −5890 | −25 | * | * | | | | | | | | | | | | |
| 16 | −309 | −3647 | 96 | −1485 | −3964 | −1113 | 159 | −3712 | 237 | −1345 | −2737 | −369 | 1885 | −226 | 1967 | −728 | −64 | 257 | 2030 | −3152 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9971 | −11013 | −894 | −1115 | −5890 | −25 | * | * | | | | | | | | | | | | |
| 17 | −1203 | −2640 | −576 | −827 | 788 | −235 | 80 | 82 | −2381 | −185 | 1690 | −2637 | −3675 | 1041 | 314 | −1209 | 1074 | −65 | −3041 | 2093 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9971 | −11013 | −894 | −1115 | −5890 | −25 | * | * | | | | | | | | | | | | |
| 18 | −908 | −3607 | 1092 | −454 | 1394 | −3169 | 218 | 393 | 834 | −3613 | 685 | 926 | 287 | 768 | 123 | −2077 | −933 | −908 | 2032 | −211 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9971 | −11013 | −894 | −1115 | −5890 | −25 | * | * | | | | | | | | | | | | |
| 19 | −176 | −2624 | −3141 | −2574 | 1425 | −1397 | 142 | 309 | −962 | −591 | −1805 | 1228 | −3686 | −2279 | −151 | 306 | 958 | −2072 | 3975 | −2607 | 21 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2 | −9971 | −11013 | −894 | −1115 | −5890 | −25 | * | * | | | | | | | | | | | | |
| 20 | 63 | 2678 | −4235 | −1046 | 1173 | −1434 | −2727 | −1827 | −3328 | −292 | 764 | −3352 | 174 | −3044 | 536 | 1450 | 664 | −614 | −2768 | 568 | 22 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −93 | −9971 | −4030 | −894 | −1115 | −5890 | −25 | * | * | | | | | | | | | | | | |
| 21 | −1027 | −3522 | 1171 | 549 | 1033 | 1159 | −1767 | 1643 | −1360 | −3526 | −2620 | 981 | −910 | −1317 | 116 | −2014 | 382 | −3129 | −3724 | −3059 | 23 |
| — | −147 | −491 | 237 | 41 | −384 | 395 | 102 | −620 | 210 | −469 | −716 | 280 | 392 | 45 | 105 | 357 | 116 | −370 | −298 | −253 | |
| E | −5045 | −92 | −5001 | −8 | −7545 | −5935 | −24 | * | * | | | | | | | | | | | | |
| 22 | −784 | −2908 | −2398 | −595 | −605 | 1885 | 1581 | −2621 | −1731 | −593 | −2061 | −2073 | −641 | −121 | −2158 | 1457 | 772 | −580 | −3242 | −181 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −269 | −9836 | −2565 | −894 | −1115 | −5956 | −23 | * | * | | | | | | | | | | | | |
| 23 | −132 | −3163 | 413 | 794 | 819 | 571 | −1545 | −3115 | −1158 | −546 | 590 | 1397 | −2969 | 277 | −1652 | 554 | −283 | −446 | −3391 | 382 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −195 | −9570 | −3001 | −894 | −1115 | −6063 | −22 | * | * | | | | | | | | | | | | |
| 24 | −272 | −3044 | −184 | 682 | 537 | 427 | −1387 | −501 | 26 | −197 | 1789 | 333 | 441 | 431 | −1490 | −330 | −17 | −498 | −3264 | −2620 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −86 | −9378 | −4156 | −894 | −1115 | −3979 | −95 | * | * | | | | | | | | | | | | |
| 25 | 906 | −3249 | 1379 | −271 | 765 | 585 | 573 | −3281 | −1066 | −1133 | −2344 | 72 | −2908 | 118 | −1569 | 792 | 77 | −2858 | 1550 | 39 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −3 | −9531 | −10573 | −894 | −1115 | −1989 | −419 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | −99 | −3120 | 331 | 109 | 12 | 538 | 737 | −2766 | −2337 | 293 | 1166 | 776 | −3833 | −2243 | −2718 | −1519 | 1661 | 112 | 1951 | −3017 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −32 | −10296 | −5581 | −894 | −1115 | −5686 | −28 | * | * | | | | | | | | | | | | |
| 27 | 193 | −3901 | 466 | −688 | −993 | 915 | −2064 | −3970 | 326 | −892 | 1527 | −136 | −3498 | 544 | 458 | 1015 | 797 | −3522 | −4085 | −585 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −296 | −10266 | −2436 | −894 | −1115 | −2260 | −338 | * | * | | | | | | | | | | | | |
| 28 | 507 | 270 | 518 | −763 | 1233 | 383 | −2295 | 1018 | 51 | −3573 | −32 | 315 | 1008 | −1906 | −2432 | 361 | −557 | −409 | −3900 | −3319 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −10372 | −11414 | −894 | −1115 | −4334 | −73 | * | * | | | | | | | | | | | | |
| 29 | −1258 | −4024 | 123 | −278 | 488 | 1923 | −2202 | −4084 | −737 | 51 | −3115 | 1887 | −1562 | −341 | −227 | −1135 | −1185 | −266 | −4211 | −413 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −192 | −10423 | −3014 | −894 | −1115 | −4154 | −83 | * | * | | | | | | | | | | | | |
| 30 | −38 | −3869 | −896 | −279 | −4162 | 345 | −2108 | 1801 | −433 | −650 | −2965 | 1221 | 333 | 285 | −665 | −2356 | −1068 | 1195 | −4069 | −3403 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −77 | −10297 | −4293 | −894 | −1115 | −4881 | −50 | * | * | | | | | | | | | | | | |
| 31 | −414 | 1371 | 1040 | −930 | 770 | −516 | −326 | 60 | −2458 | −287 | −2147 | 1997 | −3856 | −328 | −2801 | −533 | −2488 | −101 | −3359 | 1949 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −32 | −10251 | −5553 | −894 | −1115 | −5719 | −28 | * | * | | | | | | | | | | | | |
| 32 | −61 | −3859 | 943 | −649 | 303 | 1418 | −2025 | −1445 | 687 | −1070 | −2949 | 938 | −218 | −152 | 425 | −255 | −515 | −1730 | −4044 | −333 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −80 | −10220 | −4231 | −894 | −1115 | −3975 | −95 | * | * | | | | | | | | | | | | |
| 33 | −399 | −3163 | −2842 | −2286 | 1414 | −477 | −2364 | −833 | 692 | 146 | −520 | 604 | −594 | 1733 | 621 | −674 | −116 | −891 | 2219 | −3020 | 36 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −73 | −10238 | −4363 | −894 | −1115 | −4916 | −49 | * | * | | | | | | | | | | | | |
| 34 | 470 | 508 | 1149 | −521 | −1025 | 39 | 136 | 20 | −768 | 179 | 736 | 808 | 69 | −210 | 104 | −651 | 464 | −3435 | −4010 | −3334 | 37 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −120 | −10197 | −3664 | −894 | −1115 | −4976 | −47 | * | * | | | | | | | | | | | | |
| 35 | −231 | −3433 | 757 | −477 | 1408 | −567 | −2054 | −84 | −162 | −1805 | 978 | 1406 | −3464 | 275 | −2184 | 549 | −75 | −521 | 1694 | −182 | 38 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −2 | −10110 | −11152 | −894 | −1115 | −3612 | −123 | * | * | | | | | | | | | | | | |
| 36 | −1323 | −2792 | 2210 | −3009 | 1138 | −368 | 307 | 611 | −2829 | −858 | 389 | 1280 | −3988 | −2673 | 345 | −714 | −139 | 261 | −3208 | −2804 | 39 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2 | −10254 | −11296 | −894 | −1115 | −1938 | −436 | * | * | | | | | | | | | | | | |
| 37 | −64 | −3778 | −526 | −148 | −1251 | −781 | −2614 | −139 | −359 | 170 | 2379 | −328 | 1256 | 643 | −2770 | −175 | −328 | −127 | 1260 | −522 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10674 | −11716 | −894 | −1115 | −2244 | −342 | * | * | | | | | | | | | | | | |
| 38 | −80 | −4435 | 901 | 1 | −319 | −2036 | 1052 | −4506 | −171 | −4451 | −372 | 2086 | 15 | 467 | −1227 | 931 | 197 | −1472 | 484 | −223 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −10872 | −11914 | −894 | −1115 | −2267 | −336 | * | * | | | | | | | | | | | | |
| 39 | 606 | −4557 | 583 | −522 | −2038 | 1011 | 562 | −4627 | −125 | −1050 | 492 | −899 | −463 | 53 | 1841 | −1191 | 218 | −884 | −4741 | −425 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11008 | −12050 | −894 | −1115 | −1892 | −453 | * | * | | | | | | | | | | | | |
| 40 | 1429 | −3948 | −1406 | −1336 | 491 | −1377 | −624 | 302 | −1266 | −903 | 67 | 376 | 2088 | −2926 | −1416 | −744 | −816 | 410 | 969 | −3817 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11142 | −12184 | −894 | −1115 | −3460 | −137 | * | * | | | | | | | | | | | | |
| 41 | −41 | −4689 | 1362 | 199 | −2219 | −2613 | −1225 | −93 | −454 | 163 | 640 | 1143 | 274 | −154 | 24 | −22 | 774 | −1486 | −4874 | −2063 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11160 | −12202 | −894 | −1115 | −4296 | −75 | * | * | | | | | | | | | | | | |
| 42 | −174 | −4662 | −855 | 133 | 885 | 1176 | −1228 | 180 | −1767 | −2943 | −652 | 2171 | −2293 | −25 | −1382 | −667 | 996 | −635 | −4855 | −1902 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11160 | −12202 | −894 | −1115 | −4296 | −75 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 43 | 495 | −345 | 155 | 1039 | −5000 | 321 | −2860 | −4747 | −1526 | −251 | −153 | 1844 | 991 | −2402 | −290 | −426 | 206 | −494 | −4871 | −4192 | 46 |
| — | −149 | −505 | 231 | 44 | −375 | 394 | 107 | −630 | 208 | −460 | −703 | 271 | 391 | 52 | 93 | 361 | 122 | −371 | −280 | −255 | |
| C | −1359 | −713 | −12202 | −5 | −8197 | −265 | −2574 | * | * | | | | | | | | | | | | |
| 44 | 205 | −4944 | 298 | −273 | −89 | −633 | −1315 | 223 | −135 | −611 | −864 | −10 | 1341 | 974 | 54 | −152 | −29 | 131 | −5131 | −1332 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −11444 | −12486 | −894 | −1115 | −2104 | −382 | * | * | | | | | | | | | | | | |
| 45 | −932 | −4587 | −1107 | −1399 | 1080 | −1743 | −99 | −1412 | 256 | 42 | −1698 | −358 | 1380 | 792 | −3403 | −990 | 978 | 269 | 1009 | 1587 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11444 | −12486 | −894 | −1115 | −2104 | −382 | * | * | | | | | | | | | | | | |
| 46 | −606 | 1564 | −1864 | −369 | 1135 | 330 | 359 | −2865 | −1109 | 291 | −1843 | −666 | 899 | 185 | 239 | −386 | 300 | −151 | −278 | 749 | 50 |
| — | −155 | −511 | 235 | 40 | −386 | 410 | 107 | −626 | 205 | −470 | −708 | 277 | 408 | 45 | 93 | 355 | 115 | −371 | −305 | −245 | |
| T | −6608 | −15 | −12486 | −2 | −9174 | −2104 | −382 | * | * | | | | | | | | | | | | |
| 47 | 395 | 1247 | 1022 | −487 | −5279 | 821 | −3118 | −5029 | −414 | −2235 | −1204 | 1183 | −70 | 1090 | −2051 | 525 | 843 | −1659 | −5141 | −64 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11444 | −12486 | −894 | −1115 | −613 | −1530 | * | * | | | | | | | | | | | | |
| 48 | 497 | −4872 | −1398 | −235 | −2316 | 240 | −3186 | −600 | −1318 | −1885 | −3975 | −1706 | −153 | −1308 | −126 | 3 | 2310 | 359 | 1483 | 368 | 53 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11474 | −12516 | −894 | −1115 | −1315 | −741 | * | * | | | | | | | | | | | | |
| 49 | −1766 | −4987 | −1078 | 1243 | −1856 | −3033 | 1694 | −5059 | 465 | −1750 | −4076 | 2176 | 350 | 26 | 107 | 1231 | −2115 | −423 | −5170 | −4487 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11474 | −12516 | −894 | −1115 | −1315 | −741 | * | * | | | | | | | | | | | | |
| 50 | −56 | −4188 | −4102 | −1296 | −4245 | −756 | −3553 | 1166 | −839 | −44 | −507 | −1608 | 1188 | −1545 | −512 | −723 | −66 | 2228 | −4557 | −4087 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11474 | −12516 | −894 | −1115 | −1315 | −741 | * | * | | | | | | | | | | | | |
| 51 | −1126 | −3625 | −2356 | −5494 | 1566 | −2552 | −1757 | 1825 | −146 | 479 | 1098 | −4985 | −5393 | −2085 | −2379 | −3020 | −3737 | 786 | 3451 | 1513 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11474 | −12516 | −894 | −1115 | −418 | −1992 | * | * | | | | | | | | | | | | |
| 52 | −575 | −4996 | 187 | 758 | −2676 | −984 | 243 | 61 | −1231 | −1780 | −1482 | 680 | −428 | 1022 | 168 | −371 | 1381 | 1070 | −5180 | −4499 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 53 | 32 | −3637 | −2080 | −2431 | 552 | −1523 | −4229 | 1957 | −5114 | 1652 | 118 | −5003 | −5408 | −4737 | −4914 | −1969 | −515 | 1544 | −4095 | −1244 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 54 | −798 | −5000 | 141 | 942 | −1943 | −1369 | −516 | −1083 | 953 | −5016 | −1619 | 607 | 1851 | 11 | 720 | −363 | 660 | −1001 | −5183 | −788 | 59 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 55 | −537 | −4981 | −3384 | −35 | 1020 | −463 | 1365 | −2548 | 516 | −345 | −4072 | 1661 | −563 | 271 | −274 | −546 | −285 | −1393 | −5170 | 2036 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11488 | −12530 | −894 | −1115 | −701 | −1378 | * | * | | | | | | | | | | | | |
| 56 | −321 | −5000 | 784 | −525 | −5321 | 1856 | 302 | −2274 | 30 | −3238 | −4089 | 2355 | −2201 | −591 | 430 | −796 | −1525 | −1025 | −5183 | −1559 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11488 | −12530 | −894 | −1115 | −701 | −1378 | * | * | | | | | | | | | | | | |
| 57 | 39 | −5000 | 1660 | 1164 | −5321 | −452 | −3159 | −5072 | 584 | −5016 | −1273 | 709 | −2116 | 1220 | −968 | 750 | 1027 | −2741 | −5183 | −4500 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −27 | −11488 | −5785 | −894 | −1115 | −701 | −1378 | * | * | | | | | | | | | | | | |
| 58 | −1528 | −1033 | −800 | −1172 | 1308 | −1150 | 810 | −159 | −276 | −2021 | −1047 | −752 | −1276 | 444 | 1495 | −641 | 1180 | 1092 | 1194 | −1761 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −35 | −11462 | −5419 | −894 | −1115 | −1686 | −537 | * | * | | | | | | | | | | | | |
| 59 | −2441 | −3580 | −1457 | −1816 | −163 | −995 | −4172 | 1585 | −5057 | 456 | 1298 | −2284 | −2140 | −4680 | −4857 | −4385 | −3694 | 2569 | 2359 | 20 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −117 | −11428 | −3692 | −894 | −1115 | −2389 | −306 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 60 | −2137 | −4816 | 625 | 2555 | −1486 | −2486 | −949 | −1306 | −1792 | −4827 | −312 | −2982 | −4436 | 1456 | 1541 | −1197 | −491 | −1324 | 1541 | −380 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −87 | −11312 | −4107 | −894 | −1115 | −3562 | −128 | * | * | | | | | | | | | | | | |
| 61 | −2263 | −3441 | −5964 | −1698 | 1372 | −5168 | −4039 | 2314 | −4924 | 1008 | 966 | −4815 | −5214 | −4544 | −4723 | −4254 | −3557 | 1641 | 2360 | 634 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11226 | −12268 | −894 | −1115 | −4031 | −91 | * | * | | | | | | | | | | | | |
| 62 | −3560 | −3398 | −5824 | −2261 | −1598 | −5098 | −611 | 1283 | −4807 | −1526 | 192 | −12 | −1907 | −1818 | −987 | −285 | 106 | 2699 | 2474 | 201 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11226 | −12268 | −894 | −1115 | −4031 | −91 | * | * | | | | | | | | | | | | |
| 63 | −3928 | −3735 | −6275 | −5642 | 2647 | −5495 | −1058 | 1414 | −5244 | 1904 | 1199 | −5142 | −5510 | −4832 | −5033 | −4587 | −1903 | 866 | −4158 | −492 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11226 | −12268 | −894 | −1115 | −4031 | −91 | * | * | | | | | | | | | | | | |
| 64 | −1997 | −4743 | −495 | −149 | −1263 | −1344 | 495 | 869 | −427 | −310 | −693 | 1107 | 549 | 2498 | −845 | −1235 | −430 | 107 | −4930 | −4252 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −75 | −11226 | −4306 | −894 | −1115 | −4031 | −91 | * | * | | | | | | | | | | | | |
| 65 | −3217 | −4676 | 252 | −472 | −4991 | 675 | −2853 | −2885 | −2435 | −1959 | −1683 | 3551 | −1805 | 185 | −1643 | −421 | −861 | −2163 | −4863 | −1550 | 70 |
| — | −151 | −505 | 228 | 38 | −383 | 398 | 104 | −612 | 205 | −464 | −705 | 274 | 391 | 40 | 94 | 359 | 138 | −370 | −299 | −254 | |
| E | −289 | −2615 | −5775 | −1755 | −507 | −3811 | −107 | * | * | | | | | | | | | | | | |
| 66 | −612 | −4524 | 514 | −588 | −1526 | −1608 | 1538 | −474 | −974 | 661 | 1357 | 1892 | −488 | −363 | −1047 | −1673 | 87 | 72 | 307 | −450 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1 | −11134 | −12176 | −894 | −1115 | −4386 | −71 | * | * | | | | | | | | | | | | |
| 67 | 459 | −4650 | 1606 | 752 | −4961 | 757 | −774 | −441 | −1556 | −1209 | −3742 | −34 | −500 | −2383 | −2930 | 511 | 1426 | −1237 | −4840 | −1211 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −38 | −11134 | −5280 | −894 | −1115 | −1910 | −446 | * | * | | | | | | | | | | | | |
| 68 | −211 | −4722 | −419 | −227 | −186 | 281 | −2886 | −1893 | −300 | −4737 | 2366 | 570 | 919 | 651 | −1797 | 675 | 1238 | −774 | −4906 | −4224 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11191 | −12233 | −894 | −1115 | −4179 | −82 | * | * | | | | | | | | | | | | |
| 69 | −1060 | −4072 | −130 | 1202 | −1352 | 1238 | −3186 | 195 | −645 | −628 | 1986 | 108 | −636 | −2885 | −3382 | −293 | 876 | −1147 | −182 | 158 | 81 |
| — | −150 | −514 | 243 | 34 | −367 | 400 | 96 | −611 | 201 | −468 | −718 | 271 | 406 | 41 | 90 | 353 | 127 | −365 | −286 | −264 | |
| S | −3611 | −1789 | −669 | −2404 | −302 | −4179 | −82 | * | * | | | | | | | | | | | | |
| 70 | 1211 | −2178 | 389 | −3403 | −2156 | 607 | −2561 | 1162 | −3118 | 1080 | −1388 | −3151 | 776 | −2846 | −3122 | 367 | −2180 | 135 | −2637 | −2278 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −2 | −9762 | −10804 | −894 | −1115 | −14 | −6666 | * | * | | | | | | | | | | | | |
| 71 | 617 | −4914 | −102 | −874 | −2326 | −2647 | −909 | −24 | −678 | −671 | −223 | 637 | 2054 | −1296 | −123 | −219 | 735 | −145 | −691 | 45 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11488 | −12530 | −894 | −1115 | −701 | −1378 | * | * | | | | | | | | | | | | |
| 72 | −2448 | −6991 | −2289 | −2341 | −7351 | −5646 | 5180 | −7090 | −2581 | −6918 | −6175 | −2075 | −6021 | 1232 | −2563 | −5171 | −5399 | −1806 | −6997 | −6314 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 73 | −4493 | −5104 | −7645 | −7985 | −7786 | −5384 | −7107 | −7589 | −7745 | −4070 | −6903 | −1990 | 3943 | −7195 | −7387 | 741 | 538 | −2317 | −8014 | −7979 | 111 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 74 | −2359 | −4256 | −6809 | −6184 | 3041 | −6049 | −4866 | 2091 | −5792 | −586 | 3013 | −5690 | −6032 | −5345 | −5570 | −5147 | −4402 | −471 | 1877 | 533 | 112 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 75 | −9985 | −8342 | −9234 | −9620 | −9476 | −8295 | 5478 | −10922 | −9812 | −10192 | −10212 | −9658 | −8728 | −9706 | −9237 | −10555 | −10115 | −10647 | −8385 | −9365 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 76 | −6658 | −6135 | −9021 | −8407 | 289 | −8638 | −7314 | 1663 | −1619 | 2852 | 415 | −8338 | −7888 | −7056 | −7684 | −7908 | −6512 | −1167 | −265 | −6235 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 77 | −6023 | −8155 | 765 | −1518 | −8243 | −5706 | 5258 | −8269 | −5667 | −8083 | −7563 | −2274 | −6313 | −4885 | −6742 | −2475 | −6136 | −7690 | −8290 | −7104 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11488 | −12530 | −894 | −1115 | −701 | −1378 | * | * | | | | | | | | | | | | |
| 78 | −1822 | −5251 | −2049 | −6320 | −7623 | 3622 | −6592 | −7399 | −7179 | −660 | −6769 | −1963 | −6199 | −6543 | −7226 | −1722 | −5057 | −1429 | −7869 | −7635 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11488 | −12530 | −894 | −1115 | −701 | −1378 | * | * | | | | | | | | | | | | |
| 79 | −952 | −3649 | −6056 | −5427 | 1073 | −5344 | 4190 | −3143 | −5043 | −2315 | 53 | 400 | −5395 | −1663 | −4877 | −1617 | −317 | 229 | −4104 | 2548 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11488 | −12530 | −894 | −1115 | −701 | −1378 | * | * | | | | | | | | | | | | |
| 80 | −190 | −4999 | 1865 | −1222 | −651 | −4501 | −671 | −5070 | −1136 | −5015 | −372 | 1285 | −66 | 1011 | −579 | 1231 | 756 | −694 | 1622 | −4500 | 118 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11488 | −12530 | −894 | −1115 | −701 | −1378 | * | * | | | | | | | | | | | | |
| 81 | −2671 | −3795 | −6282 | −5668 | 4305 | −2660 | −4287 | −3304 | −5266 | −3649 | −357 | −1741 | −2105 | −4878 | −5065 | −1519 | −3910 | −1386 | 1243 | −529 | 119 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 82 | 221 | −4941 | 737 | −676 | 1364 | −4518 | −1354 | −2360 | 12 | −1256 | −1346 | −1561 | −4610 | 2168 | 745 | −643 | −1972 | −1312 | 1933 | 1995 | 120 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 83 | −807 | −3650 | −2122 | −5536 | −1428 | −5374 | −4247 | 1536 | −5131 | 903 | −23 | −5020 | −5424 | −4755 | −4932 | −2222 | −1440 | 2942 | −4112 | −1245 | 121 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 84 | −2632 | −3673 | −5854 | −1023 | −3631 | −5312 | −4168 | 1388 | −1524 | 1814 | −2874 | −1801 | −2194 | −4570 | −733 | −2207 | −747 | 2328 | −4125 | −1532 | 122 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 85 | 485 | −298 | 379 | 2 | −1652 | 2220 | −408 | −5071 | −824 | −2760 | −4088 | 31 | −4594 | 147 | 1092 | 392 | −1265 | −1773 | −5183 | −2010 | 123 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 86 | −1550 | −4595 | −3653 | −622 | −564 | −913 | −145 | −843 | −912 | −2022 | 1820 | −3369 | −1793 | 1470 | 1967 | 1104 | 342 | −225 | −4882 | 862 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 87 | 46 | −5000 | 1448 | −480 | −5321 | 2245 | 448 | −5072 | −1625 | −2068 | −4089 | 858 | −4594 | −259 | −1131 | 849 | −274 | −2703 | −5183 | −4500 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 88 | −1538 | −4909 | 107 | −340 | 1091 | 1893 | −959 | −758 | −1383 | −1695 | −1233 | 387 | 1295 | −2745 | 531 | −481 | −47 | −825 | −5117 | −1301 | 126 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 89 | 35 | −4998 | −149 | −65 | −678 | 2341 | −738 | −2246 | −396 | −850 | −4088 | 296 | −935 | −223 | −393 | 301 | −915 | −2160 | −5182 | −197 | 127 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −1 | −11488 | −12530 | −894 | −1115 | −701 | −1378 | * | * | | | | | | | | | | | | |
| 90 | −956 | −4990 | 579 | −676 | −183 | −672 | −3162 | −1280 | 494 | −1870 | −363 | 1635 | 1424 | 352 | 183 | −141 | 592 | −1980 | 122 | 461 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −279 | −11488 | −2512 | −894 | −1115 | −701 | −1378 | * | * | | | | | | | | | | | | |
| 91 | −161 | −4321 | 211 | −567 | 1606 | −101 | −908 | −768 | −1549 | −1718 | −3456 | −837 | 1164 | −2697 | −1611 | −1992 | 470 | −933 | 3668 | 1544 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −223 | −11210 | −2811 | −894 | −1115 | −4100 | −87 | * | * | | | | | | | | | | | | |
| 92 | −629 | −4532 | 1741 | −733 | −2215 | 561 | −2703 | −4596 | −2285 | −2460 | −3622 | 1456 | −903 | 581 | −1249 | 465 | 1241 | −1591 | 125 | 1410 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −216 | −10989 | −2849 | −894 | −1115 | −4785 | −53 | * | * | | | | | | | | | | | | |
| 93 | 169 | −4336 | 616 | 525 | −1689 | 59 | −2510 | −570 | −36 | −2410 | −3427 | 827 | 2453 | −422 | −213 | −2757 | −400 | −2124 | 242 | −142 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −68 | −10773 | −4465 | −894 | −1115 | −5180 | −40 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 94 | 480 | −4269 | 1038 | 396 | 341 | −789 | 41 | −998 | 71 | −1283 | −3360 | 826 | −3887 | −811 | −822 | 256 | 790 | −248 | 1484 | 469 | 132 |
| — | −147 | −521 | 245 | 55 | −382 | 390 | 98 | −619 | 206 | −470 | −732 | 276 | 403 | 36 | 101 | 354 | 122 | −371 | −314 | −245 | |
| H | −2109 | −543 | −3612 | −2770 | −229 | −5274 | −38 | * | * | | | | | | | | | | | | |
| 95 | −418 | 459 | 2280 | −327 | −4500 | −450 | −415 | −4250 | 558 | −2101 | 374 | −849 | 356 | −93 | −2426 | 1062 | 888 | −3801 | −4362 | −3680 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10584 | −11626 | −894 | −1115 | −3336 | −150 | * | * | | | | | | | | | | | | |
| 96 | −508 | −4256 | −685 | −743 | −4573 | −2020 | −2426 | −4321 | −219 | −1538 | 1332 | 149 | 2260 | −1967 | 2055 | 308 | 32 | −1773 | −4441 | −179 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −1 | −10680 | −11722 | −894 | −1115 | −3174 | −169 | * | * | | | | | | | | | | | | |
| 97 | 1082 | −4345 | −180 | −266 | −1531 | −336 | 1213 | −1689 | 665 | −399 | −3434 | −781 | 267 | −423 | 201 | 613 | 362 | 152 | −4529 | −3846 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −1 | −10773 | −11815 | −894 | −1115 | −4416 | −69 | * | * | | | | | | | | | | | | |
| 98 | −325 | −4347 | −2747 | −808 | −4660 | −969 | 973 | −1080 | 1345 | −739 | −225 | 300 | 380 | −898 | 852 | 751 | 1244 | −6 | −4535 | −3857 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10792 | −11834 | −894 | −1115 | −3655 | −119 | * | * | | | | | | | | | | | | |
| 99 | −1540 | −3495 | −805 | −1309 | 1690 | −4310 | −763 | −674 | −1352 | 1078 | −2670 | −639 | 173 | −2880 | −80 | −656 | −947 | −1040 | 1339 | 2848 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10839 | −11881 | −894 | −1115 | −884 | −1127 | * | * | | | | | | | | | | | | |
| 100 | −405 | −4746 | −1634 | −909 | 396 | −1163 | −2918 | −1012 | −48 | −4761 | −1187 | 3314 | 426 | 400 | 342 | −3165 | −1564 | −4366 | −152 | −221 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11224 | −12266 | −894 | −1115 | −3114 | −177 | * | * | | | | | | | | | | | | |
| 101 | −328 | −551 | −1650 | −388 | 1088 | −590 | −1087 | −4719 | −378 | 1491 | −3799 | −1020 | 1344 | −991 | −1741 | −1088 | −228 | −1185 | −4904 | 1818 | 159 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −11241 | −12283 | −894 | −1115 | −1489 | −635 | * | * | | | | | | | | | | | | |
| 102 | −555 | −4845 | 482 | 1272 | −1512 | −2735 | 1223 | −1311 | 380 | −2428 | −3935 | 395 | −1145 | −493 | −1154 | 211 | −420 | 1670 | 1653 | −848 | 160 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11326 | −12368 | −894 | −1115 | −3461 | −137 | * | * | | | | | | | | | | | | |
| 103 | 39 | −4848 | 2431 | 41 | −5169 | −1485 | −3010 | −1627 | −1394 | −2675 | −3938 | 2651 | −1839 | −1193 | −695 | −1340 | −455 | −1111 | −5032 | 182 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11326 | −12368 | −894 | −1115 | −994 | −1006 | * | * | | | | | | | | | | | | |
| 104 | 693 | −4909 | −607 | −2764 | −5222 | −76 | −3094 | −4966 | −1107 | −541 | −4001 | −3073 | 3334 | −46 | 216 | −1170 | −1344 | −4527 | −5098 | −1633 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11406 | −12449 | −894 | −1115 | −1893 | −452 | * | * | | | | | | | | | | | | |
| 105 | −480 | −3595 | −5883 | −971 | −1587 | 928 | −4123 | 385 | −4899 | −1492 | 1739 | −2171 | 2124 | 232 | −1896 | −2494 | −633 | 1628 | 253 | −367 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11419 | −12461 | −894 | −1115 | −2520 | −276 | * | * | | | | | | | | | | | | |
| 106 | −683 | −4027 | −4244 | 322 | −468 | −4851 | 267 | −981 | −1063 | −162 | −645 | −3820 | −503 | −729 | 2525 | 321 | −2244 | −1261 | 3383 | 163 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11419 | −12461 | −894 | −1115 | −167 | −3197 | * | * | | | | | | | | | | | | |
| 107 | −1542 | −1870 | −1672 | −859 | −1708 | −4573 | −1363 | −4731 | 2008 | −1254 | −913 | −3249 | −4663 | −2815 | 3372 | −3490 | −816 | −4380 | −216 | −4417 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 108 | −2246 | 37 | 3641 | −4915 | −7110 | −2364 | 1915 | −6890 | −5356 | −6987 | −6105 | 1347 | −5908 | −5086 | −5787 | −597 | −1491 | −2118 | −7188 | −6675 | 166 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11488 | −12530 | −894 | −1115 | −701 | −1378 | * | * | | | | | | | | | | | | |
| 109 | −4555 | −4770 | −7374 | −7198 | −5612 | −5710 | −6164 | −1526 | −6879 | −5283 | −4770 | −2671 | −6277 | −6490 | −6665 | −721 | 3499 | 2005 | −6241 | −2738 | 167 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 110 | 223 | −3683 | −6211 | −2759 | 835 | −5418 | −4294 | 1519 | −5175 | −654 | −1154 | −5064 | −5466 | −4800 | −4977 | −4505 | 584 | 2760 | −4158 | 687 | 168 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 111 | 265 | −4940 | 43 | −234 | −5234 | 306 | −1128 | −888 | −2771 | −376 | 1398 | 621 | −669 | 1886 | −397 | −47 | −36 | −616 | 1634 | 112 | 169 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 112 | −739 | −3783 | −6331 | −5704 | −3764 | −5549 | −2119 | 1252 | −5308 | 1366 | 349 | −5196 | −5592 | −4936 | −5114 | −2765 | −290 | 2842 | −4297 | −3953 | 170 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −49 | −11488 | −4929 | −894 | −1115 | −701 | −1378 | * | * | | | | | | | | | | | | |
| 113 | −833 | −4946 | −1808 | −68 | −1050 | 821 | −959 | −5010 | −1476 | −1153 | −4036 | 20 | 2863 | −285 | 6 | −2142 | −1429 | −1350 | −548 | 1670 | 171 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −89 | −11440 | −4076 | −894 | −1115 | −2177 | −361 | * | * | | | | | | | | | | | | |
| 114 | 742 | −4757 | −996 | −2766 | −5025 | 378 | −794 | −436 | −457 | −3448 | −1676 | −838 | 2965 | −2633 | −484 | −85 | −256 | −104 | −4972 | −4322 | 172 |
| — | −142 | −501 | 233 | 42 | −382 | 400 | 104 | −628 | 209 | −467 | −722 | 275 | 394 | 47 | 94 | 358 | 119 | −370 | −296 | −251 | |
| T | −118 | −3670 | −12394 | −889 | −1121 | −97 | −3939 | * | * | | | | | | | | | | | | |
| 115 | −80 | −4996 | 202 | −1069 | −1214 | 2420 | 30 | −1520 | −527 | −2401 | −103 | 1595 | −743 | −128 | −796 | −891 | −1536 | −4617 | 366 | −762 | 177 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11488 | −12530 | −894 | −1115 | −701 | −1378 | * | * | | | | | | | | | | | | |
| 116 | 231 | −5018 | 8 | 710 | −5339 | 2720 | −1006 | −5090 | −1528 | −5034 | −4108 | −1652 | −4608 | 820 | −3266 | 600 | −296 | −2267 | −5202 | −4518 | 178 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 117 | −3533 | −4943 | −3406 | −1234 | −385 | −870 | 1175 | −4971 | 1 | −4948 | −67 | 978 | −4610 | −535 | 415 | −934 | 787 | −772 | 4507 | 1746 | 179 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 118 | 1007 | −3644 | −6091 | −2295 | −124 | −2416 | −264 | 343 | −5068 | 448 | 1330 | −4974 | −5399 | −721 | −716 | −913 | 1562 | 1840 | −4101 | −3757 | 180 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 119 | 1632 | −3921 | −4721 | −455 | −3920 | −5054 | −3830 | 618 | −1262 | −1746 | −3107 | −4182 | −5122 | −2087 | 1303 | −1104 | 1526 | 1718 | −275 | −3935 | 181 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11488 | −12530 | −894 | −1115 | −701 | −1378 | * | * | | | | | | | | | | | | |
| 120 | −875 | −4983 | −7806 | −7266 | −229 | −7245 | −6280 | 2971 | −6976 | 1076 | −1805 | −6899 | −7082 | −6522 | −6804 | −6418 | −5287 | 1809 | −5828 | 167 | 182 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −18 | −11488 | −6356 | −894 | −1115 | −701 | −1378 | * | * | | | | | | | | | | | | |
| 121 | 1472 | −4178 | −527 | 149 | −4232 | −4831 | −3557 | −2150 | −3423 | 302 | 655 | −3732 | −4910 | −537 | 2958 | −3795 | −1847 | −2141 | −4547 | 139 | 183 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11470 | −12512 | −894 | −1115 | −1429 | −670 | * | * | | | | | | | | | | | | |
| 122 | −712 | −3624 | −6144 | −5508 | 3739 | −1948 | −4217 | −16 | −5102 | −390 | 668 | −4992 | −5395 | −4725 | −4902 | −4430 | −1937 | 1115 | 730 | 64 | 184 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11470 | −12512 | −894 | −1115 | −1429 | −670 | * | * | | | | | | | | | | | | |
| 123 | −229 | −4948 | 130 | −812 | −1283 | −4494 | 1361 | −321 | 1481 | −1810 | −1405 | −1994 | −4587 | 326 | 1546 | −183 | 392 | 926 | −5142 | 264 | 185 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −31 | −11470 | −5574 | −894 | −1115 | −1429 | −670 | * | * | | | | | | | | | | | | |
| 124 | 2494 | −3593 | −6104 | −5468 | 1638 | −5312 | −4183 | −3085 | −5065 | −33 | 440 | −2311 | −224 | −4689 | −4867 | −1014 | 1257 | −807 | −4051 | 443 | 186 |
| — | −152 | −503 | 234 | 42 | −379 | 398 | 117 | −629 | 209 | −467 | −723 | 276 | 396 | 47 | 98 | 358 | 118 | −372 | −297 | −244 | |
| E | −143 | −3409 | −12482 | −1452 | −656 | −678 | −1416 | * | * | | | | | | | | | | | | |
| 125 | 37 | −4983 | 3340 | −531 | −5304 | −701 | −3143 | −5055 | −1907 | −2741 | −4073 | 860 | −500 | −650 | −1177 | −1051 | −1074 | −2461 | −5167 | −493 | 190 |
| — | −149 | −502 | 239 | 42 | −383 | 401 | 103 | −628 | 208 | −468 | −723 | 276 | 401 | 43 | 95 | 357 | 117 | −371 | −287 | −248 | |
| — | −325 | −2311 | −12512 | −12 | −6923 | −381 | −2107 | * | * | | | | | | | | | | | | |
| 126 | −150 | −4830 | −537 | −291 | −1241 | −2274 | 34 | −2199 | −2835 | −4814 | −1082 | 3727 | −1268 | −2788 | −1799 | −1118 | −3486 | −2588 | 272 | 587 | 192 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11488 | −12530 | −894 | −1115 | −701 | −1378 | * | * | | | | | | | | | | | | |
| 127 | 433 | −4865 | −2117 | −2079 | −2449 | −4541 | 426 | −4836 | −1363 | −2282 | −3970 | −3203 | 3509 | −547 | −2248 | −196 | −352 | −268 | −5085 | −907 | 193 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11488 | −12530 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 128 | -2418 | -1172 | -6422 | -5845 | -975 | 3644 | -230 | -3572 | -5447 | -3897 | -3272 | -5280 | -5735 | -1689 | -5260 | -4752 | -2347 | -2630 | -168 | -1152 | 194 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -11488 | -12530 | -894 | -1115 | -701 | -1378 | * | * | | | | | | | | | | | | |
| 129 | 899 | -4472 | -394 | -1181 | -577 | -4695 | -3389 | -337 | -1197 | -2090 | 1898 | -1350 | 1840 | -1498 | 353 | -1002 | -653 | 1678 | -4786 | -630 | 195 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -11488 | -12530 | -894 | -1115 | -701 | -1378 | * | * | | | | | | | | | | | | |
| 130 | -7788 | -6881 | -8415 | -8582 | 918 | -8224 | -4560 | -6794 | -2502 | -6221 | -6234 | -6907 | -8099 | -6941 | -2291 | -7464 | -2342 | -2342 | 5908 | 1916 | 196 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -11488 | -12530 | -894 | -1115 | -701 | -1378 | * | * | | | | | | | | | | | | |
| 131 | 93 | -3637 | -6156 | -5520 | 2237 | -5358 | -4230 | -592 | -5115 | 1461 | 2903 | 1161 | -2427 | -1669 | -4915 | -4443 | -1976 | 273 | -4095 | -344 | 197 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -11488 | -12530 | -894 | -1115 | -701 | -1378 | * | * | | | | | | | | | | | | |
| 132 | -1867 | -951 | -6331 | -5696 | 2919 | -5540 | -4405 | 336 | -5294 | 1586 | 2069 | -5187 | -5575 | -4900 | -5088 | -4628 | -3924 | -373 | 1583 | 1713 | 198 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -11488 | -12530 | -894 | -1115 | -701 | -1378 | * | * | | | | | | | | | | | | |
| 133 | -6338 | -7222 | -5000 | -1292 | -6667 | -6420 | 5214 | -7405 | -3621 | -6997 | -6431 | -2147 | -6632 | -4425 | 1062 | -6084 | -6115 | -7162 | -6407 | -1762 | 199 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1 | -11488 | -12530 | -894 | -1115 | -701 | -1378 | * | * | | | | | | | | | | | | |
| 134 | -4486 | 5616 | -7907 | -8248 | -7781 | -5384 | -7165 | -3032 | -7849 | -7834 | -6887 | -6232 | -1378 | -7274 | -7438 | 560 | -1553 | -3150 | -8023 | -8006 | 200 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -7 | -11488 | -7799 | -894 | -1115 | -701 | -1378 | * | * | | | | | | | | | | | | |
| 135 | -2241 | -7737 | -2224 | 30 | -7903 | -5647 | 5212 | -7831 | -2167 | -7670 | -7035 | -2259 | -6193 | -201 | -5989 | -5426 | -5857 | -2370 | -7848 | -6825 | 201 |
| — | -149 | -500 | 233 | 43 | -381 | 399 | 106 | -626 | 210 | -466 | -720 | 275 | 394 | 45 | 96 | 359 | 117 | -369 | -294 | -249 | |
| S | -1 | -11481 | -12524 | -894 | -1115 | -1006 | -994 | * | * | | | | | | | | | | | | |
| 136 | -2130 | -3632 | -6144 | -5508 | -51 | -5351 | -120 | 2920 | -713 | 665 | 1229 | 929 | -5401 | -1079 | -4906 | -4436 | -2160 | 662 | -4089 | -1004 | 202 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -1 | -11481 | -12524 | -894 | -1115 | -1006 | -994 | * | * | | | | | | | | | | | | |
| 137 | 433 | -4873 | 1834 | 1140 | -5140 | -829 | -3196 | -1447 | -2800 | 1479 | -399 | -1652 | -2429 | -161 | -3297 | -644 | -235 | -4466 | 2127 | -4441 | 203 |
| — | -146 | -493 | 238 | 49 | -382 | 397 | 104 | -628 | 209 | -467 | -722 | 274 | 395 | 44 | 95 | 359 | 116 | -371 | -296 | -251 | |
| H | -6646 | -2974 | -213 | -19 | -6285 | -1006 | -994 | * | * | | | | | | | | | | | | |
| 138 | -1338 | -2767 | -1202 | -639 | -3111 | -2293 | -910 | -2839 | 395 | -2771 | -1862 | 312 | 580 | 832 | 2771 | 404 | 759 | -2404 | -2920 | -2277 | 205 |
| — | -149 | -500 | 233 | 43 | -381 | 399 | 106 | -626 | 210 | -466 | -720 | 275 | 394 | 45 | 96 | 359 | 117 | -369 | -294 | -249 | |
| . | -5 | -8618 | -9660 | -894 | -1115 | -66 | -4473 | * | * | | | | | | | | | | | | |
| 139 | -896 | -4637 | -934 | 1247 | 526 | -2411 | 28 | -114 | -2050 | -1034 | -3762 | -3266 | -1133 | 823 | -602 | -1602 | -1457 | -426 | 4496 | 995 | 206 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -1 | -11440 | -12482 | -894 | -1115 | -2177 | -361 | * | * | | | | | | | | | | | | |
| 140 | -7991 | -6960 | -8431 | -8701 | -3053 | -8291 | 5188 | -1567 | -7970 | -6234 | -331 | -6915 | -8148 | -6998 | -2520 | -7540 | -7837 | -7056 | 117 | 1823 | 207 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -1 | -11440 | -12482 | -894 | -1115 | -2177 | -361 | * | * | | | | | | | | | | | | |
| 141 | 717 | -3775 | -5009 | 1270 | -3757 | -5101 | -792 | -533 | -2843 | 1713 | 2261 | -2405 | -5164 | -95 | -4359 | -1131 | 159 | 385 | -4207 | -3826 | 208 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -1 | -11440 | -12482 | -894 | -1115 | -2177 | -361 | * | * | | | | | | | | | | | | |
| 142 | -754 | -4954 | 1953 | 1218 | -5274 | 882 | -1071 | -2754 | -1650 | -2696 | -111 | -1170 | -1705 | 654 | -3203 | 1112 | 617 | -372 | -5137 | -4455 | 209 |
| — | -149 | -500 | 233 | 43 | -381 | 399 | 106 | -626 | 210 | -466 | -720 | 275 | 394 | 45 | 96 | 359 | 117 | -369 | -294 | -249 | |
| C | -1 | -11440 | -12482 | -894 | -1115 | -2177 | -361 | * | * | | | | | | | | | | | | |
| 143 | 905 | -4793 | -3426 | 520 | -1777 | -1015 | 86 | -1347 | -1820 | -1396 | 1730 | 652 | -1825 | 2122 | -578 | -250 | 21 | -1512 | 2740 | -718 | 210 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -1 | -11440 | -12482 | -894 | -1115 | -2177 | -361 | * | * | | | | | | | | | | | | |
| 144 | -1720 | -7949 | -408 | -42 | -8077 | 3519 | -1266 | -8059 | -5433 | -7882 | -7313 | -4224 | -6227 | 573 | -1966 | -5499 | -5990 | -7500 | -8075 | -6959 | 211 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -1 | -11440 | -12482 | -894 | -1115 | -2177 | -361 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 145 | −4894 | 170 | −7246 | −6616 | 1054 | −6517 | −5364 | −2268 | −6238 | 2074 | 4186 | −6173 | −6417 | −5711 | −5990 | −1891 | −1454 | −2533 | −4981 | −4768 | 212 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −11440 | −12482 | −894 | −1115 | −2177 | −361 | * | * | | | | | | | | | | | | |
| 146 | 1875 | −3614 | −5907 | −2268 | −134 | −375 | −4143 | −1892 | −1087 | −1309 | 3231 | −1465 | −5335 | −4581 | −4791 | 477 | −1127 | −130 | −4069 | 1721 | 213 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11440 | −12482 | −894 | −1115 | −2177 | −361 | * | * | | | | | | | | | | | | |
| 147 | 598 | −3594 | −6090 | −5455 | −1467 | 831 | −23 | −805 | −5055 | 559 | 2846 | −1454 | −5360 | −4681 | 782 | −1751 | 362 | 1424 | −4051 | −3708 | 214 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11440 | −12482 | −894 | −1115 | −2177 | −361 | * | * | | | | | | | | | | | | |
| 148 | 315 | −4926 | −1488 | −343 | −5233 | −1425 | −3124 | −1697 | −1408 | −1851 | −279 | −734 | −157 | 2214 | 579 | 190 | −19 | 1782 | −35 | −1509 | 215 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11440 | −12482 | −894 | −1115 | −1709 | −527 | * | * | | | | | | | | | | | | |
| 149 | −2642 | −3711 | −6235 | −5601 | 3416 | −5443 | −4306 | −145 | −5197 | 787 | 976 | −5088 | −5483 | −4809 | −2378 | −4529 | −3830 | 1481 | 356 | 1054 | 216 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11446 | −12488 | −894 | −1115 | −2049 | −399 | * | * | | | | | | | | | | | | |
| 150 | 285 | −4367 | −712 | −624 | −4473 | −4688 | −3389 | 1292 | −423 | 889 | −34 | −754 | −1056 | −429 | 106 | −2781 | −44 | 1518 | 799 | 151 | 217 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11446 | −12488 | −894 | −1115 | −2049 | −399 | * | * | | | | | | | | | | | | |
| 151 | −2448 | −4263 | −621 | 2043 | −4342 | −2679 | −3462 | 515 | −3266 | −3319 | −3423 | −305 | −2313 | −3183 | −3674 | −1240 | 579 | 2515 | −4613 | −47 | 218 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −256 | −11446 | −2623 | −894 | −1115 | −2049 | −399 | * | * | | | | | | | | | | | | |
| 152 | 272 | −4719 | 1271 | −246 | −2112 | 516 | −2887 | −2231 | 520 | −305 | −201 | −713 | 629 | −152 | 1178 | −274 | −492 | −847 | −4904 | −145 | 219 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −24 | −11191 | −5944 | −894 | −1115 | −4179 | −82 | * | * | | | | | | | | | | | | |
| 153 | −904 | −4703 | 1159 | 820 | −5024 | −2356 | −2863 | −356 | −127 | −2828 | −3792 | 1093 | 2428 | −678 | −925 | −801 | 70 | 278 | −4887 | −4204 | 220 |
| — | −144 | −509 | 240 | 46 | −384 | 409 | 104 | −631 | 210 | −468 | −722 | 273 | 394 | 53 | 92 | 356 | 113 | −374 | −303 | −256 | |
| H | −6332 | −18 | −12210 | −3 | −8896 | −48 | −4945 | * | * | | | | | | | | | | | | |
| 154 | −366 | −5000 | 1376 | 1087 | −5321 | −114 | −120 | −2368 | 269 | −1638 | −1289 | −66 | 180 | 486 | 97 | 1016 | −919 | 44 | −5183 | −2208 | 222 |
| — | * | * | * | * | * | * | * | * | * | * | * | * | * | * | * | * | * | * | * | * | |
| H | * | * | * | * | * | * | * | * | 0 | | | | | | | | | | | | |
| // | | | | | | | | | | | | | | | | | | | | | |

| | | | | | | | | | | | | | | | | | | | | | |
|---|---|---|---|---|---|---|---|---|---|---|---|---|---|---|---|---|---|---|---|---|---|
| HMMER2.0 | [2.3.2] | | | | | | | | | | | | | | | | | | | | |
| NAME | Cu-oxidase_3 | | | | | | | | | | | | | | | | | | | | |
| ACC | PF07732.7 | | | | | | | | | | | | | | | | | | | | |
| DESC | Multicopper oxidase | | | | | | | | | | | | | | | | | | | | |
| LENG | 124 | | | | | | | | | | | | | | | | | | | | |
| ALPH | Amino | | | | | | | | | | | | | | | | | | | | |
| RF | no | | | | | | | | | | | | | | | | | | | | |
| CS | yes | | | | | | | | | | | | | | | | | | | | |
| MAP | yes | | | | | | | | | | | | | | | | | | | | |
| COM | hmmbuild -F HMM_ls.ann SEED.ann | | | | | | | | | | | | | | | | | | | | |
| COM | hmmcalibrate --seed 0 HMM_ls.ann | | | | | | | | | | | | | | | | | | | | |
| NSEQ | 122 | | | | | | | | | | | | | | | | | | | | |
| DATE | Thu Apr 24 19:18:22 2008 | | | | | | | | | | | | | | | | | | | | |
| CKSUM | 2340 | | | | | | | | | | | | | | | | | | | | |
| GA | 10.0000 10.0000; | | | | | | | | | | | | | | | | | | | | |
| TC | 10.2000 10.2000; | | | | | | | | | | | | | | | | | | | | |
| NC | 9.6000 9.6000; | | | | | | | | | | | | | | | | | | | | |
| XT | −8455 | −4 | −1000 | −1000 | −8455 | −4 | −8455 | −4 | | | | | | | | | | | | | |
| NULT | −4 | −8455 | | | | | | | | | | | | | | | | | | | |
| NULE | 595 | −1558 | 85 | 338 | −294 | 453 | −1158 | 197 | 249 | 902 | −1085 | −142 | −21 | −313 | 45 | 531 | 201 | 384 | −1998 | −644 | |
| EVD | −92.985649 | 0.242445 | | | | | | | | | | | | | | | | | | | |
| HMM | A | C | D | E | F | G | H | I | K | L | M | N | P | Q | R | S | T | V | W | Y | |
| | m->m | m->i | m->d | i->m | i->i | d->m | d->d | b->m | m->e | | | | | | | | | | | | |
| | −27 | * | −5729 | | | | | | | | | | | | | | | | | | |
| 1 | −548 | −4429 | 781 | 864 | −4750 | −2608 | 573 | −2244 | 1037 | −1194 | −3518 | 1151 | −4023 | 470 | 68 | −490 | 1382 | 631 | −4612 | −3929 | 1 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −11 | −10865 | −7137 | −894 | −1115 | −701 | −1378 | −27 | * | | | | | | | | | | | | |
| 2 | 678 | 812 | −5539 | −1632 | −2999 | −4761 | −1203 | 1602 | −4504 | −43 | 11 | −898 | −2400 | −4131 | −4312 | −1616 | 457 | 2518 | −3503 | −3160 | 2 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10855 | −11897 | −894 | −1115 | −1014 | −986 | * | * | | | | | | | | | | | | |
| 3 | 97 | −4420 | −1986 | 1047 | −769 | 677 | −2579 | −4492 | 301 | −4436 | −3509 | −1548 | −1885 | 1976 | 328 | 460 | 1616 | −1380 | −4603 | −3920 | 3 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −14 | −10855 | −6742 | −894 | −1115 | −535 | −1691 | * | * | | | | | | | | | | | | |
| 4 | −700 | −4410 | −143 | 1165 | −1808 | −3920 | −494 | −4476 | 26 | −879 | 880 | −236 | 22 | −391 | 409 | 96 | 370 | −1030 | 2499 | 2042 | 4 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10852 | −11894 | −894 | −1115 | −1101 | −906 | * | * | | | | | | | | | | | | |
| 5 | 88 | −4413 | −156 | 147 | −4731 | 1084 | −1010 | 222 | 858 | −2149 | 853 | −1831 | −1306 | −92 | −819 | 413 | 1041 | 441 | −4597 | −3916 | 5 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10852 | −11894 | −894 | −1115 | −1101 | −906 | * | * | | | | | | | | | | | | |
| 6 | −1195 | −4410 | 360 | −107 | −2397 | −3920 | 768 | −2025 | −88 | −1610 | −1289 | 1890 | 638 | 1210 | −360 | −803 | 1544 | −465 | −331 | 120 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −15 | −10852 | −6633 | −894 | −1115 | −497 | −1778 | * | * | | | | | | | | | | | | |
| 7 | 792 | 1826 | −1378 | −706 | 28 | −760 | −788 | 1527 | −1596 | −1765 | −2367 | −3947 | −2104 | −3614 | −48 | −923 | −682 | 1628 | 2029 | 448 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 8 | −82 | −4264 | −2878 | −196 | −734 | −3962 | −1103 | −181 | 173 | −488 | −3371 | 1298 | −1348 | −374 | 377 | 1183 | 1579 | −1092 | −885 | 239 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 9 | −1004 | −3175 | −2057 | −4080 | 1557 | −872 | 111 | 642 | −720 | −106 | 59 | −2250 | 2360 | −1960 | 1436 | −3642 | −3110 | 213 | −3614 | −411 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 10 | 469 | −3646 | 1830 | −1215 | −3710 | −926 | −2951 | −1834 | −1825 | 1574 | −113 | −340 | 682 | −2700 | −3180 | −874 | 116 | −674 | 483 | −939 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10851 | −11893 | −894 | −1115 | −1128 | −882 | * | * | | | | | | | | | | | | |
| 11 | −1416 | 3651 | 1620 | −1375 | −4724 | 2307 | −2578 | −4472 | −448 | −2264 | −1199 | −1321 | −575 | −807 | −1735 | −1768 | −1373 | −4027 | −4593 | −1259 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −161 | −10851 | −3254 | −894 | −1115 | −1128 | −882 | * | * | | | | | | | | | | | | |
| 12 | −1295 | −4120 | −2737 | −1714 | −205 | 2076 | 1299 | −1253 | 1114 | −2041 | −3227 | 334 | −3911 | −569 | −464 | 413 | −880 | −454 | −4345 | 1385 | 12 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10691 | −11733 | −894 | −1115 | −293 | −2443 | * | * | | | | | | | | | | | | |
| 13 | −470 | −4304 | −1797 | 11 | −1753 | −1078 | −911 | −1641 | 383 | −317 | 772 | −1721 | −40 | −1155 | −362 | 457 | 1924 | 1043 | −4516 | −305 | 13 |
| — | −149 | −500 | 232 | 43 | −379 | 399 | 105 | −625 | 210 | −466 | −721 | 276 | 395 | 45 | 95 | 359 | 117 | −366 | −295 | −250 | |
| E | −1283 | −4009 | −924 | −287 | −2469 | −1321 | −737 | * | * | | | | | | | | | | | | |
| 14 | 386 | −3485 | −693 | 1125 | −3806 | −2987 | 473 | −3557 | 1210 | −1732 | 724 | 421 | 1542 | −527 | −366 | −184 | 981 | −1507 | −3669 | −2986 | 16 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −2 | −9764 | −10806 | −894 | −1115 | −276 | −2521 | * | * | | | | | | | | | | | | |
| 15 | 324 | −4311 | −1829 | −832 | −4633 | −1377 | 1040 | −4383 | 1419 | −4328 | −3401 | 263 | −3905 | 1551 | 2160 | −468 | 1030 | −981 | −4495 | −3812 | 17 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10733 | −11775 | −894 | −1115 | −1254 | −784 | * | * | | | | | | | | | | | | |
| 16 | −584 | −4353 | 532 | 538 | −4674 | −3855 | −134 | −1819 | 974 | −2290 | −109 | 159 | 1342 | 1589 | −52 | 523 | 362 | −1331 | −136 | −812 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10781 | −11823 | −894 | −1115 | −1151 | −863 | * | * | | | | | | | | | | | | |
| 17 | 814 | −99 | −1760 | −4886 | −715 | −204 | −3597 | 1183 | −4481 | −184 | 1938 | −4371 | −4775 | −4104 | −4282 | −658 | 414 | 2229 | −3462 | −3120 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10812 | −11855 | −894 | −1115 | −1876 | −459 | * | * | | | | | | | | | | | | |
| 18 | −774 | −3016 | −5410 | −1912 | −2972 | −4709 | −3574 | 2228 | −1800 | 404 | 2287 | −4319 | −1612 | −653 | −1945 | −2353 | 218 | 897 | 3465 | −3128 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10812 | −11855 | −894 | −1115 | −1876 | −459 | * | * | | | | | | | | | | | | |
| 19 | 727 | −3011 | −5526 | −4891 | −648 | 1737 | −3605 | −1679 | −4487 | 526 | −1018 | −4377 | −4781 | −4111 | −4289 | −939 | 2234 | 937 | −3471 | −3129 | 21 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10812 | −11855 | −894 | −1115 | −690 | −1395 | * | * | | | | | | | | | | | | |
| 20 | −1717 | −756 | −5658 | −1965 | 1269 | −4871 | −3753 | 2108 | −4629 | −2957 | −768 | −4517 | −4917 | −4256 | −4433 | −3960 | −1820 | 2537 | −3615 | 2352 | 22 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10845 | −11887 | −894 | −1115 | −436 | −1938 | * | * | | | | | | | | | | | | |
| 21 | −2321 | −7037 | −329 | −3347 | −7601 | −929 | −4630 | −7605 | −2395 | −7451 | −6895 | 4277 | −5693 | −4335 | −6111 | −4929 | −5422 | −6947 | −7650 | −6528 | 23 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −13 | −10865 | −6869 | −894 | −1115 | −701 | −1378 | * | * | | | | | | | | | | | | |
| 22 | −1892 | −4662 | −3 | −1370 | −4978 | 3255 | −275 | −4734 | −1271 | −4675 | −3757 | 801 | −1905 | −660 | −58 | −2105 | −3115 | −4282 | −4842 | −4146 | 24 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10853 | −11895 | −894 | −1115 | −1072 | −931 | * | * | | | | | | | | | | | | |
| 23 | −378 | −4418 | −622 | 153 | −4739 | −632 | −910 | −2482 | 552 | −2631 | 1667 | 225 | −4012 | 2761 | −298 | 667 | 573 | −4040 | −4601 | −1014 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10853 | −11895 | −894 | −1115 | −1072 | −931 | * | * | | | | | | | | | | | | |
| 24 | −2010 | −91 | −5560 | −4924 | 3056 | −2321 | −3633 | 402 | −4519 | 687 | 581 | −4408 | −4812 | −4142 | −4319 | −111 | −3155 | 201 | 1866 | 2139 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10853 | −11895 | −894 | −1115 | −1072 | −931 | * | * | | | | | | | | | | | | |
| 25 | −2227 | −5400 | −8282 | −7686 | −2076 | −7846 | −6617 | −2132 | −7425 | 796 | −590 | −7563 | 3949 | −6406 | −6998 | −7107 | −5767 | −1964 | −5469 | −5579 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −1 | −10853 | −11895 | −894 | −1115 | −1072 | −931 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | −132 | −557 | −5641 | −5096 | −3574 | 3520 | −4042 | −1708 | −4700 | −1909 | −2812 | −1625 | −1215 | −4408 | −2174 | −3894 | −3443 | −2997 | −480 | −3716 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10853 | −11895 | −894 | −1115 | −1072 | −931 | * | * | | | | | | | | | | | | |
| 27 | −2088 | −5019 | −1888 | −4568 | −7184 | −4870 | −5397 | −7017 | −5754 | −7147 | 164 | −4557 | 4187 | −1519 | −6160 | −4377 | −2076 | −5969 | −7339 | −6850 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −14 | −10853 | −6730 | −894 | −1115 | −1072 | −931 | * | * | | | | | | | | | | | | |
| 28 | 692 | −4366 | −588 | −87 | −4669 | −3918 | −1291 | −326 | −666 | −143 | −1741 | −958 | −300 | −1115 | −204 | −1824 | 2781 | −461 | −4561 | −3889 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10839 | −11881 | −894 | −1115 | −1393 | −691 | * | * | | | | | | | | | | | | |
| 29 | −5499 | −5012 | −8000 | −7494 | −602 | −7648 | −6702 | 3195 | −7291 | 1729 | −170 | −7323 | −7156 | −6549 | −7035 | −2824 | −5422 | 620 | −5717 | −5699 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10839 | −11881 | −894 | −1115 | −1393 | −691 | * | * | | | | | | | | | | | | |
| 30 | −2934 | −4401 | −465 | 1353 | −1178 | −3908 | 979 | 449 | 826 | −4416 | −3491 | 1028 | −2043 | −459 | 2050 | −1993 | −382 | 421 | −844 | −152 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10839 | −11881 | −894 | −1115 | −1393 | −691 | * | * | | | | | | | | | | | | |
| 31 | 1934 | 1122 | −2366 | −4911 | −132 | −4750 | −3621 | −629 | −4506 | 775 | 116 | −4396 | −4800 | −1965 | −4306 | −1373 | −3143 | 2136 | 2101 | −3144 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10839 | −11881 | −894 | −1115 | −830 | −1193 | * | * | | | | | | | | | | | | |
| 32 | −2101 | 1532 | 1140 | −872 | −298 | −3924 | 528 | −2151 | 912 | −3074 | −182 | 640 | −482 | 333 | 2131 | −1689 | 487 | −344 | −567 | −1685 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −23 | −10851 | −6021 | −894 | −1115 | −1103 | −904 | * | * | | | | | | | | | | | | |
| 33 | −827 | −4395 | −2773 | 2184 | −4714 | −3899 | −2558 | −4464 | 1284 | −2742 | −3484 | −158 | −3992 | 924 | 232 | 102 | 514 | −1412 | 2814 | 153 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10829 | −11872 | −894 | −1115 | −1208 | −818 | * | * | | | | | | | | | | | | |
| 34 | −5176 | −6763 | −43 | −3398 | −6837 | 3467 | −4621 | −7476 | −5119 | −7323 | −741 | 1680 | −5683 | −4367 | −6094 | −4887 | −5357 | −6819 | −7120 | −1366 | 36 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10837 | −11879 | −894 | −1115 | −1438 | −665 | * | * | | | | | | | | | | | | |
| 35 | −2933 | −4406 | 3549 | −78 | −4727 | −3906 | −1400 | −4478 | 186 | −4422 | −3495 | −512 | −4000 | 300 | −504 | −1211 | −1161 | −2512 | 335 | −1364 | 37 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10837 | −11879 | −894 | −1115 | −831 | −1192 | * | * | | | | | | | | | | | | |
| 36 | −1670 | −4410 | 386 | 857 | −485 | −3918 | −2577 | −2510 | −913 | −3325 | −1087 | 1537 | −1164 | 11 | 1763 | −414 | 1789 | −2178 | 1675 | −1012 | 38 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 37 | −690 | −3778 | −6500 | −5937 | −1526 | −5834 | −4854 | 1496 | −5603 | 1152 | −3032 | −5484 | −5824 | −5276 | −5459 | −2785 | −364 | 2936 | −4667 | −4304 | 39 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 38 | −1512 | −4165 | −1476 | 474 | −1430 | −2331 | −546 | 1217 | −115 | −1228 | −3282 | −1120 | −4085 | −230 | 220 | −1691 | 1021 | 2193 | 1029 | −1649 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 39 | −1621 | −4713 | −7850 | −7468 | −1737 | −7629 | −7231 | 2607 | −7375 | 733 | −202 | −7288 | −7283 | −7034 | −7372 | −6967 | −5188 | 2728 | −6421 | −6162 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 40 | −2944 | −4413 | 1274 | −897 | −1696 | −3918 | 1777 | −1637 | 1063 | −1954 | −3502 | 2432 | −4011 | −2117 | 1654 | −710 | 458 | −4034 | −4597 | −851 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 41 | −4393 | −4126 | −6759 | −6145 | 962 | −6057 | −4906 | 314 | −5779 | 487 | −9 | −5707 | −5951 | −833 | −5542 | −5177 | −4322 | 3220 | −4514 | 558 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 42 | −1971 | −4247 | −1688 | −210 | 485 | −3967 | 1689 | 1639 | −63 | −1535 | −3356 | −1394 | −1912 | −492 | −352 | −472 | 1922 | 503 | −4476 | 423 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 43 | −8641 | −7558 | −8171 | −8559 | −8966 | −7501 | −8085 | −10112 | −8962 | −9478 | −9402 | 4460 | −7968 | −8777 | −8497 | −9028 | −8880 | −9666 | −7785 | −8900 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 44 | −742 | −4416 | −149 | −920 | −4737 | −1210 | 2771 | −4488 | 1447 | −4432 | −1252 | 2051 | −4010 | 1005 | 1314 | −119 | −1417 | −4038 | −4600 | −861 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10851 | −11893 | −894 | −1115 | −1128 | −882 | * | * | | | | | | | | | | | | |
| 45 | −39 | −3055 | −5576 | −4941 | −946 | −2095 | −3652 | 592 | −4536 | 2587 | 1116 | −4425 | −4828 | −4159 | −4336 | −419 | −1992 | 607 | −3516 | −3174 | 47 |
| — | −148 | −500 | 233 | 43 | −381 | 398 | 105 | −627 | 210 | −466 | −721 | 275 | 393 | 47 | 96 | 360 | 119 | −370 | −295 | −250 | |
| S | −2322 | −4617 | −397 | −606 | −1544 | −486 | −1805 | * | * | | | | | | | | | | | | |
| 46 | 120 | −2800 | −1180 | 310 | −3120 | −681 | 443 | −2869 | 1009 | 105 | 448 | 804 | 995 | 252 | 819 | 417 | −425 | −2421 | −2985 | −2303 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | −8855 | −9897 | −894 | −1115 | −20 | −6166 | * | * | | | | | | | | | | | | |
| 47 | −791 | −4429 | 1769 | −1100 | −4750 | −796 | −163 | −1510 | −129 | −4445 | −700 | 580 | 1831 | 854 | −305 | 187 | 1093 | −4051 | −528 | −992 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10865 | −11907 | −894 | −1115 | −701 | −1378 | * | * | | | | | | | | | | | | |
| 48 | −1433 | −4421 | 677 | 2550 | −77 | −3932 | 527 | −4487 | −2172 | −3006 | −3511 | 1609 | −4025 | 769 | −1490 | −1939 | −874 | −1034 | −4607 | 1652 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10865 | −11907 | −894 | −1115 | −701 | −1378 | * | * | | | | | | | | | | | | |
| 49 | −753 | −4429 | −268 | 225 | −4750 | 1379 | −172 | −4500 | −2169 | −1978 | −3518 | 2284 | 1858 | −971 | −1706 | 113 | 266 | −2700 | −4612 | −3929 | 53 |
| — | −149 | −500 | 234 | 43 | −379 | 398 | 105 | −627 | 210 | −466 | −717 | 279 | 393 | 45 | 96 | 359 | 117 | −370 | −295 | −250 | |
| — | −72 | −4364 | −11907 | −71 | −4383 | −701 | −1378 | * | * | | | | | | | | | | | | |
| 50 | −1841 | −3063 | −5583 | −4947 | 733 | −4787 | −3659 | 594 | −4543 | −162 | 704 | −1400 | −4836 | −4167 | −4344 | −580 | 3061 | 1044 | −3525 | −3182 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −1 | −10865 | −11907 | −894 | −1115 | −701 | −1378 | * | * | | | | | | | | | | | | |
| 51 | −466 | −3423 | −5778 | −5245 | −3598 | −1826 | −4116 | −1576 | −4883 | 260 | −2838 | −1486 | −5022 | −4527 | −4734 | 2157 | 2799 | −937 | −4088 | −3751 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 52 | −5952 | −5369 | −8479 | −7998 | −29 | −8328 | −7386 | 3042 | −7875 | 1000 | 2210 | −8026 | −7534 | −6889 | −7534 | −7725 | −5855 | 1515 | −5964 | −6099 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 53 | −4082 | −4758 | −5065 | −5434 | −7060 | −4844 | 5204 | −7114 | −6149 | −7277 | −6389 | −1123 | −5619 | −5733 | −6259 | −492 | 562 | −5885 | −7271 | −6884 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 54 | −5337 | −4951 | −7160 | −6860 | 842 | −6633 | −4073 | −841 | −6456 | −849 | −3798 | −5873 | −6567 | −5730 | −6110 | −2530 | −5257 | −946 | 5941 | −1031 | 59 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 55 | −2794 | −6705 | −1537 | −3284 | −7229 | −4998 | 5171 | −7156 | −4710 | −7036 | −6368 | 819 | −2948 | −365 | −5555 | −2068 | −2061 | −6559 | −7229 | −6228 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 56 | −8794 | −7589 | −8580 | −8967 | −9149 | 3866 | −8235 | −10213 | −9163 | −9555 | −9501 | −8901 | −8026 | −9034 | −8589 | −9262 | −9036 | −9777 | −7838 | −9165 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −17 | −10865 | −6479 | −894 | −1115 | −701 | −1378 | * | * | | | | | | | | | | | | |
| 57 | −654 | −3147 | −5678 | −5045 | 145 | −4888 | −3763 | 2427 | −4643 | 1763 | 1505 | −4535 | −4929 | −839 | −4443 | −1374 | −3269 | 1068 | −3614 | −3278 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10849 | −11891 | −894 | −1115 | −1174 | −845 | * | * | | | | | | | | | | | | |
| 58 | −1771 | −4399 | −349 | 332 | 886 | −3919 | 2340 | −659 | 203 | −366 | −1396 | −1217 | −592 | 1587 | 2065 | −802 | −2882 | −1683 | −4587 | −884 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10849 | −11891 | −894 | −1115 | −1174 | −845 | * | * | | | | | | | | | | | | |
| 59 | −1076 | −3078 | −5224 | −4608 | −3038 | −4709 | 683 | 446 | −1891 | 423 | 1796 | −1857 | −4762 | 3385 | −4181 | −1053 | −3139 | 993 | −3531 | −3180 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10849 | −11891 | −894 | −1115 | −1174 | −845 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 60 | −3019 | −1185 | −1086 | −1850 | 16 | −4125 | 220 | −1687 | 345 | 367 | −890 | 620 | 2350 | −2492 | 2080 | −770 | −1886 | −2028 | −1145 | −873 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10849 | −11891 | −894 | −1115 | −1174 | −845 | * | * | | | | | | | | | | | | |
| 61 | −367 | −4407 | −678 | −688 | −89 | 1553 | −2576 | −2150 | 789 | −1245 | 305 | 955 | −399 | −1484 | 1861 | −330 | −1006 | −4028 | 808 | −3912 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −10849 | −11891 | −894 | −1115 | −468 | −1851 | * | * | | | | | | | | | | | | |
| 62 | −654 | −4429 | −1014 | 739 | −4750 | −1694 | 229 | −2722 | −393 | −4445 | −700 | 2226 | −393 | −350 | −2676 | 714 | 2278 | −2884 | −4612 | −3929 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −613 | −10865 | −1533 | −894 | −1115 | −701 | −1378 | * | * | | | | | | | | | | | | |
| 63 | −1085 | 1558 | −4883 | −4256 | −1048 | 1280 | −3065 | −186 | −3879 | −1750 | −1716 | 1695 | 2333 | −3527 | −3725 | 875 | −2607 | −87 | 708 | −2624 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −2 | −10253 | −11295 | −894 | −1115 | −4427 | −69 | * | * | | | | | | | | | | | | |
| 64 | −2642 | −2597 | −1939 | −233 | 815 | −4104 | 264 | −392 | −3453 | −1215 | −551 | −3514 | −1868 | −537 | −3482 | −3156 | −77 | −2018 | 5257 | 1677 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −2 | −10253 | −11295 | −894 | −1115 | −1389 | −694 | * | * | | | | | | | | | | | | |
| 65 | 1670 | −3595 | −673 | −2308 | −3725 | −3794 | −931 | −1905 | −2204 | −3527 | 3734 | −798 | −3881 | 1935 | −2652 | 86 | −2646 | −2254 | −3906 | 660 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1 | −10506 | −11548 | −894 | −1115 | −3838 | −105 | * | * | | | | | | | | | | | | |
| 66 | −7080 | −7102 | 4202 | −5675 | −8418 | −1957 | −6529 | −9063 | −7150 | −8642 | −8354 | −5998 | −7014 | −6525 | −7537 | −6994 | −7281 | −8494 | −7442 | −7997 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1 | −10506 | −11548 | −894 | −1115 | −3838 | −105 | * | * | | | | | | | | | | | | |
| 67 | −8283 | −7186 | −8187 | −8573 | −8761 | 3865 | −7853 | −9803 | −8774 | −9168 | −9092 | −8477 | −7638 | −8636 | −8208 | −8726 | −8546 | −9330 | −7470 | −8775 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −26 | −10506 | −5879 | −894 | −1115 | −160 | −3255 | * | * | | | | | | | | | | | | |
| 68 | 366 | −3025 | −5435 | −4806 | −983 | −4721 | −847 | −2518 | −4421 | −697 | 578 | −826 | 1979 | −862 | −4255 | −1369 | −337 | 2703 | −443 | −3136 | 73 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −10823 | −11866 | −894 | −1115 | −794 | −1241 | * | * | | | | | | | | | | | | |
| 69 | 872 | −4361 | 1598 | 254 | −2053 | −936 | −2588 | −4393 | −2178 | −629 | −1222 | 735 | 2272 | −810 | −1730 | −594 | −1868 | −259 | −4558 | −773 | 74 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10846 | −11888 | −894 | −1115 | −1247 | −789 | * | * | | | | | | | | | | | | |
| 70 | −1463 | −3993 | −1412 | −1713 | 600 | 2909 | −37 | −3746 | −2633 | −3922 | 1335 | −2936 | −4276 | −23 | −3084 | −1613 | −3059 | −3507 | −4296 | 2359 | 75 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −170 | −10846 | −3173 | −894 | −1115 | −1247 | −789 | * | * | | | | | | | | | | | | |
| 71 | −3054 | −2881 | −5395 | −4760 | −2835 | 1140 | −488 | 2063 | −4355 | 556 | −256 | −383 | −4651 | −3979 | −4157 | −1288 | −2994 | 2214 | 1115 | −2997 | 76 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10677 | −11719 | −894 | −1115 | −108 | −3792 | * | * | | | | | | | | | | | | |
| 72 | −962 | −313 | −7130 | −7336 | −6852 | −4756 | −6350 | −6604 | −6973 | −6887 | −5984 | −5546 | 1771 | −1503 | −6647 | 1278 | 3262 | −1077 | −7125 | −7034 | 77 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10865 | −11907 | −894 | −1115 | −701 | −1378 | * | * | | | | | | | | | | | | |
| 73 | −1172 | −4432 | −1322 | 718 | 625 | −2444 | 1254 | −4500 | −2179 | −4447 | 1116 | 720 | −4030 | 3584 | −2687 | −761 | −1315 | −4053 | −4617 | −3935 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10865 | −11907 | −894 | −1115 | −701 | −1378 | * | * | | | | | | | | | | | | |
| 74 | −845 | 4887 | 824 | −2742 | −1455 | −2075 | −217 | −1610 | −1025 | −2423 | −1504 | −403 | −107 | −1219 | −92 | −3109 | −1745 | −2518 | 871 | −490 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 75 | 30 | −3101 | −5174 | −2252 | −3062 | 163 | −768 | −626 | −4236 | −1628 | 374 | −4226 | 3544 | −1908 | −4170 | −2184 | −901 | −186 | −3552 | −1136 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 76 | −3891 | −3639 | −3229 | −5712 | −1479 | −5594 | −4556 | 3682 | −5354 | −372 | −520 | −5241 | −5598 | −5004 | −5189 | −2581 | −1066 | 568 | −4379 | −4028 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −1 | −10865 | −11907 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 77 | 733 | −1619 | −2807 | 98 | −4738 | −1969 | −2591 | −4486 | 473 | −2216 | −409 | 505 | 2352 | 2094 | −30 | −1484 | −591 | −1039 | −4606 | −1215 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 78 | −351 | −3765 | −4934 | −4433 | −4160 | −4613 | −4050 | −2347 | −2335 | −4042 | −1526 | −1428 | 3857 | −4050 | −4409 | −406 | 511 | −1916 | −4569 | −4191 | 83 |
| — | −149 | −500 | 233 | 43 | −381 | 398 | 106 | −626 | 211 | −466 | −720 | 276 | 394 | 45 | 97 | 359 | 117 | −369 | −294 | −249 | |
| T | −32 | −5539 | −11907 | −147 | −3369 | −701 | −1378 | * | * | | | | | | | | | | | | |
| 79 | −3225 | −4716 | −1179 | −1636 | −1694 | 3435 | −13 | −4787 | −642 | −4728 | −3813 | 284 | −4247 | −1234 | −2149 | −2185 | −1591 | −4336 | −4896 | −4199 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10865 | −11907 | −894 | −1115 | −701 | −1378 | * | * | | | | | | | | | | | | |
| 80 | 396 | −4429 | −210 | 1600 | −4750 | 1016 | 327 | −4501 | 264 | −4445 | −3518 | −726 | −4023 | 2011 | −1995 | 212 | 495 | −4051 | 1597 | −3930 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 81 | −1640 | −4428 | −386 | −245 | −956 | −2322 | 465 | −4499 | 172 | −4444 | −916 | 1477 | −4023 | −1066 | −570 | 1858 | 1991 | −1225 | −4611 | −229 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 82 | −4286 | −4253 | −5712 | −5004 | 2990 | −5550 | −3713 | −3833 | 882 | −1330 | 215 | −1225 | −5568 | −395 | 654 | −4655 | −4194 | −3750 | 3227 | 2826 | 88 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 83 | −1218 | −4355 | 443 | −817 | −4643 | −3951 | 130 | −1072 | −1755 | −501 | −3453 | −1215 | −4043 | −246 | 66 | −73 | 2819 | 848 | −4559 | −1360 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 84 | −6513 | −5839 | −7592 | −7662 | −568 | −7304 | −843 | −1177 | −7215 | −5286 | −5137 | −6164 | 512 | −2389 | −6728 | −6501 | −6411 | −1029 | −3212 | 4671 | 90 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 85 | −1574 | −4429 | −171 | 768 | −4750 | −3930 | −1288 | −978 | 1394 | −2991 | −3518 | 1702 | −4023 | 615 | 2131 | −590 | 266 | −1386 | −4612 | −393 | 91 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 86 | −5802 | −5327 | −7673 | −7353 | 4116 | −7229 | −4665 | 200 | −6989 | −685 | −1517 | −6483 | −6959 | −6098 | −6582 | −6413 | −5695 | −742 | 1553 | 1262 | 92 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 87 | −1152 | −4428 | 444 | −915 | −4749 | −3930 | −1325 | −449 | 699 | −1600 | −3518 | 236 | 919 | 2009 | 792 | −1903 | 2083 | −2693 | −4612 | −3929 | 93 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 88 | 1241 | −3091 | −5617 | −4983 | −409 | −4824 | −3700 | 1271 | −4581 | 341 | −920 | 13 | 402 | −4205 | −4383 | −3910 | −1259 | 2468 | −3564 | −3221 | 94 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 89 | −1344 | −4429 | 1235 | 248 | −4750 | −2174 | 323 | −1990 | 1375 | −2678 | −1205 | 564 | 550 | −372 | 588 | −427 | 1515 | −562 | −4612 | −606 | 95 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 90 | −2956 | −4429 | 1633 | −247 | −4750 | 935 | −24 | −2470 | −479 | −2113 | −3518 | 166 | −1945 | 3198 | −343 | −2836 | −914 | −1451 | −4612 | −3929 | 96 |
| — | −148 | −500 | 234 | 44 | −381 | 399 | 105 | −627 | 210 | −466 | −721 | 275 | 393 | 45 | 96 | 359 | 117 | −370 | −295 | −250 | |
| S | −929 | −4471 | −1219 | −76 | −4286 | −701 | −1378 | * | * | | | | | | | | | | | | |
| 91 | −865 | −3728 | −112 | 442 | −1037 | −3230 | −1890 | −3798 | −1471 | −3744 | −2818 | −259 | 1320 | 3399 | −272 | 246 | −2197 | −1521 | −3912 | −3230 | 98 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2 | −10055 | −11097 | −894 | −1115 | −66 | −4474 | * | * | | | | | | | | | | | | |
| 92 | 1697 | −4410 | −1772 | 612 | −4728 | −1207 | −1313 | 728 | −819 | −4424 | −3500 | −314 | −741 | −2119 | 917 | 749 | −1402 | −1312 | −4595 | 1959 | 99 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −10851 | −11893 | −894 | −1115 | −1128 | −882 | * | * | | | | | | | | | | | | |
| 93 | 540 | −467 | −7106 | −7285 | −7142 | 3540 | −6341 | −6946 | −2214 | −7185 | −6227 | −5536 | −5561 | −6363 | −1018 | −1535 | −2315 | −5666 | −7318 | −7284 | 100 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 94 | −3927 | −4529 | −7136 | −7486 | −976 | −4813 | −6368 | −7004 | −7199 | −7205 | −6307 | −5620 | −5624 | −6626 | −6814 | 1436 | 3741 | −5730 | −6908 | −6416 | 101 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 95 | −1119 | 1725 | −5550 | −4914 | 1791 | −4759 | 1334 | −1673 | −4511 | 1396 | −2243 | −953 | −4809 | −4135 | −4314 | −114 | −1 | −1704 | −3497 | 3017 | 102 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −1128 | −882 | * | * | | | | | | | | | | | | |
| 96 | −4126 | −3894 | −6287 | −5771 | 1941 | −5580 | −3791 | −3402 | −5362 | −636 | −696 | −2739 | −5605 | −4874 | −5117 | −3058 | −2632 | −2461 | 5783 | −548 | 103 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10851 | −11893 | −894 | −1115 | −486 | −1805 | * | * | | | | | | | | | | | | |
| 97 | −7448 | −6392 | −7885 | −8223 | 336 | −7761 | −3965 | −2924 | −7783 | −2646 | −5608 | −6383 | −7606 | −6508 | −7149 | −7008 | −7298 | −1268 | 4244 | 4357 | 104 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 98 | −7417 | −6410 | −7790 | −8084 | 1351 | −7691 | 5260 | −6404 | −7407 | −5713 | −5801 | −6335 | −7574 | −6432 | −2461 | −3593 | −7285 | −6550 | −3208 | −1201 | 105 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 99 | 1920 | −4621 | −150 | −5966 | −7252 | −298 | −6140 | −7094 | −6742 | −7316 | −6374 | −5216 | 2399 | −6095 | −6715 | 2236 | −4437 | −5798 | −7455 | −7285 | 106 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 100 | −2397 | −4520 | −1858 | −3763 | −1655 | −4603 | 5135 | −5020 | −4022 | −5206 | −4421 | −1185 | −2794 | −3828 | −4454 | 236 | −1290 | −2520 | −5562 | −5046 | 107 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 101 | 362 | −375 | −1273 | −2394 | 1270 | −4740 | −3599 | 709 | −2689 | −125 | 597 | −2145 | 410 | −2194 | −4242 | 1170 | 1116 | 113 | −3532 | 1372 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 102 | −125 | −445 | 122 | −1448 | −4743 | 1137 | 2256 | −2539 | −260 | −676 | 1329 | −237 | −842 | −204 | −464 | 1740 | −2895 | −2539 | −4609 | −3927 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10865 | −11907 | −894 | −1115 | −701 | −1378 | * | * | | | | | | | | | | | | |
| 103 | −88 | −3350 | −1412 | −1926 | 1199 | 1165 | 1107 | −2911 | −3357 | 446 | 1597 | −732 | −356 | −3204 | −3607 | −13 | −220 | −1353 | 3671 | −3359 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −912 | −10865 | −1095 | −894 | −1115 | −701 | −1378 | * | * | | | | | | | | | | | | |
| 104 | −1331 | −3472 | −2111 | −294 | −3721 | −3190 | 1621 | −1670 | 538 | 1755 | 1323 | 754 | −3281 | 248 | −351 | −130 | −14 | −409 | −3701 | −3065 | 111 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −100 | −9955 | −3927 | −894 | −1115 | −4836 | −51 | * | * | | | | | | | | | | | | |
| 105 | −944 | −2778 | −2636 | 520 | −2847 | −3377 | −2104 | −987 | −1943 | −2683 | 731 | −2265 | −3460 | −1858 | 2703 | −174 | 2182 | −344 | −3148 | −2673 | 112 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −842 | −9857 | −1181 | −894 | −1115 | −4934 | −48 | * | * | | | | | | | | | | | | |
| 106 | 2906 | −2523 | −2573 | −2086 | −3357 | 628 | −2193 | −3007 | −1976 | −3192 | 687 | −2138 | −781 | 141 | −2367 | −500 | 109 | −2597 | −3547 | −3063 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −122 | −9020 | −3663 | −894 | −1115 | −495 | −1783 | * | * | | | | | | | | | | | | |
| 107 | −2694 | −4163 | −1082 | 1335 | −4488 | −3654 | 1950 | −4236 | −47 | −4176 | −3253 | −2289 | −1855 | 3647 | −406 | −2572 | −1256 | −3788 | −4339 | 54 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10490 | −11532 | −894 | −1115 | −3887 | −101 | * | * | | | | | | | | | | | | |
| 108 | −1708 | −4123 | −2513 | 903 | −4447 | −3632 | 279 | −4193 | 160 | −4136 | −526 | 148 | −3724 | 2542 | 1893 | −2542 | −2598 | −1565 | −4302 | 2632 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10490 | −11532 | −894 | −1115 | −3887 | −101 | * | * | | | | | | | | | | | | |
| 109 | 1872 | −2805 | −4550 | −1229 | −506 | 912 | −3149 | −2317 | −3674 | −768 | 213 | −3731 | −34 | 1130 | −3698 | −1129 | 394 | 1330 | 36 | −2888 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1525 | −10490 | −617 | −894 | −1115 | −3887 | −101 | * | * | | | | | | | | | | | | |
| 110 | 589 | −2090 | −3930 | −3394 | 404 | 739 | 917 | −1632 | −3089 | −1904 | −1307 | −2995 | −3663 | −2740 | −3038 | −2692 | −172 | −1554 | 1830 | 3819 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | −8969 | −10011 | −894 | −1115 | −21 | −6128 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 111 | 1957 | −4427 | 1420 | −896 | −923 | −2351 | −629 | −4498 | −97 | −2503 | 1953 | 1103 | −4023 | −463 | 831 | −561 | −1151 | −2910 | −4611 | −1765 | 118 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10865 | −11907 | −894 | −1115 | −701 | −1378 | * | * | | | | | | | | | | | | |
| 112 | −3902 | −4513 | −7064 | −7422 | −7239 | 3500 | −6537 | −7076 | −7206 | −7332 | −6357 | −5601 | −5604 | −6629 | −6831 | −1885 | 1747 | −5737 | −7445 | −7437 | 119 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10865 | −11907 | −894 | −1115 | −701 | −1378 | * | * | | | | | | | | | | | | |
| 113 | −906 | −3054 | −5572 | −4936 | −1644 | 435 | −1236 | 281 | −4531 | 1944 | 1599 | −4421 | −4825 | 244 | −4331 | −3860 | −3168 | 1985 | −3511 | −1473 | 120 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 114 | 1346 | −3057 | −5522 | −4889 | 1379 | −1878 | 1897 | −2550 | −4495 | −605 | −541 | −4397 | −4817 | −4127 | 85 | −907 | −1012 | 406 | −3514 | 3175 | 121 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 115 | −1018 | −4518 | −7153 | −7509 | −7248 | 3755 | −6558 | −7082 | −7235 | −7339 | −6365 | −5624 | −5612 | −6658 | −6844 | −4168 | −1087 | −5744 | −7448 | −7452 | 122 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 116 | 2080 | −3055 | −5563 | −4928 | −128 | 151 | −3645 | −1729 | −4525 | 356 | 1517 | −4416 | 2170 | −4150 | −4328 | −822 | −559 | −695 | −3513 | −3171 | 123 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 117 | −5037 | −4706 | −7371 | −6759 | 2079 | −6735 | −5444 | 2386 | −6411 | 1579 | 1412 | −6377 | −6470 | −5721 | −6105 | −5880 | −4942 | 333 | 1874 | 550 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 118 | −3225 | −3054 | −5557 | −4922 | −1637 | −4771 | −28 | 2846 | −2538 | 142 | −919 | −932 | −4821 | −2162 | −242 | −3855 | −798 | 2048 | −3511 | −399 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 119 | −5212 | −4683 | −7904 | −7590 | −407 | −7791 | −7817 | 3282 | −7576 | −1496 | −3835 | −7444 | −7457 | −7450 | −7726 | −7192 | −5199 | 2502 | −6985 | −6549 | 126 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 120 | −2957 | −4420 | 1065 | 1407 | −1703 | −3932 | 2008 | −4484 | 49 | −75 | −3510 | 1343 | −4025 | −2132 | 1619 | −1270 | −1198 | −1991 | −1101 | 1426 | 127 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10865 | −11907 | −894 | −1115 | −701 | −1378 | * | * | | | | | | | | | | | | |
| 121 | −337 | −4428 | 2106 | −907 | −4749 | 800 | −2588 | −4500 | −988 | −2493 | −974 | −57 | 2532 | −436 | −1532 | 179 | −1429 | −2693 | −4612 | −3929 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1 | −10865 | −11907 | −894 | −1115 | −701 | −1378 | * | * | | | | | | | | | | | | |
| 122 | −30 | −388 | 403 | 207 | −4750 | −1589 | −705 | −2471 | 1571 | −1483 | −1727 | −1870 | 2164 | −894 | 1717 | −680 | −1014 | −4051 | −4612 | −3929 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10865 | −11907 | −894 | −1115 | −701 | −1378 | * | * | | | | | | | | | | | | |
| 123 | 1127 | −4429 | 305 | 968 | −1741 | −1204 | −593 | −4501 | 874 | −987 | −3518 | 1015 | 748 | 21 | −367 | 331 | −369 | −1475 | −4612 | −1273 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10865 | −11907 | −894 | −1115 | −701 | −1378 | * | * | | | | | | | | | | | | |
| 124 | −969 | −4427 | 965 | 588 | −1263 | 1156 | −679 | −637 | −827 | −1222 | −3517 | −34 | 1120 | −279 | −477 | 1266 | −402 | −1402 | −4611 | −3929 | 131 |
| — | * | * | * | * | * | * | * | * | * | * | * | * | * | * | * | * | * | * | * | * | |
| H | * | * | * | * | * | * | * | * | 0 | | | | | | | | | | | | |
| // | | | | | | | | | | | | | | | | | | | | | |

```
HMMER2.0        [2.3.2]
NAME Flavodoxin_1
ACC             PF00258.17
DESC Flavodoxin
LENG            170
ALPH            Amino
RF              no
CS              yes
MAP             yes
COM             hmmbuild -F HMM_ls.ann SEED.ann
COM             hmmcalibrate --seed 0 HMM_ls.ann
NSEQ            93
DATE            Thu Apr 24 21:29:35 2008
CKSUM           2289
GA              6.3000 6.3000;
TC              6.7000 6.7000;
NC              6.2000 6.2000;
XT              -8455  -4  -1000  -1000  -8455  -4  -8455  -4
NULT            -4  -8455
NULE            595  -1558  85  338  -294  453  -1158  197  249  902  -1085  -142  -21  -313  45  531  201  384  -1998  -644
EVD             -68.967041  0.218391
HMM      A       C       D       E       F       G       H       I       K       L       M       N       P       Q       R       S       T       V       W       Y
        m->m    m->i    m->d    i->m    i->i    d->m    d->d    b->m    m->e
         -20      *    -6151
1      -5631   -5102   -8327   -8015   -5580   -8217   -8285    3112   -8005     526   -4262   -7873   -7883   -7887   -8161   -7622   -5618    2474   -7444   -7016     1
—       -149    -500     233      43    -381     399     106    -626     210    -466    -720     275     394      45      96     359     117    -369    -294    -249
E         -1  -11295  -12337    -894   -1115    -701   -1378     -20       *
2      -2071   -3517   -6045   -5412    2586   -2178   -4128    1673   -5009    1531    -909   -4899   -5298   -4631   -4810   -4339   -1781    1672   -3988   -1124     2
—       -149    -500     233      43    -381     399     106    -626     210    -466    -720     275     394      45      96     359     117    -369    -294    -249
E         -1  -11295  -12337    -894   -1115    -701   -1378       *       *
3      -6665   -6122   -8005   -8056    2649   -7560   -4425   -1177   -7638   -5604   -5451   -6585   -7551   -6658   -7162   -1002   -2718   -1547   -3711    4331     3
—       -149    -500     233      43    -381     399     106    -626     210    -466    -720     275     394      45      96     359     117    -369    -294    -249
E         -1  -11295  -12337    -894   -1115    -701   -1378       *       *
4       1566   -4647    1109   -4441   -4656    2591    -832   -4681   -4643   -4933   -4242   -4480   -5518   -4407   -4965    -656   -4277   -1954    1575    1820     4
—       -149    -500     233      43    -381     399     106    -626     210    -466    -720     275     394      45      96     359     117    -369    -294    -249
E         -1  -11295  -12337    -894   -1115    -701   -1378       *       *
5      -4457   -5055   -7645   -8001   -7744   -5329   -7062   -7618   -7737   -7860   -6900   -6160   -6140   -7178   -7348    3219    2463   -6288   -7890   -7929     5
—       -149    -500     233      43    -381     399     106    -626     210    -466    -720     275     394      45      96     359     117    -369    -294    -249
S         -1  -11295  -12337    -894   -1115    -701   -1378       *       *
6      -1138   -4818     595    1081   -5138    -828   -2981   -1340   -1203   -1405    2824      25   -4415    2432    -478    -776     778   -2350   -5002   -4320     6
—       -149    -500     233      43    -381     399     106    -626     210    -466    -720     275     394      45      96     359     117    -369    -294    -249
S         -1  -11295  -12337    -894   -1115    -701   -1378       *       *
7      -3680   -3586   -5562   -4960   -3458    -768      17   -3095   -4632   -1187    -830   -4647   -5220    -592   -4589     367    3196   -3009    1476    2367     7
—       -149    -500     233      43    -381     399     106    -626     210    -466    -720     275     394      45      96     359     117    -369    -294    -249
S         -1  -11295  -12337    -894   -1115    -701   -1378       *       *
8      -5101    -611   -3900   -1856   -7333    3710    -779   -7639   -5724   -7629   -6939    -805   -6082   -5116   -6396   -2522   -5409   -6771   -7561   -1486     8
—       -149    -500     233      43    -381     399     106    -626     210    -466    -720     275     394      45      96     359     117    -369    -294    -249
C         -1  -11295  -12337    -894   -1115    -701   -1378       *       *
```

-continued

| | | | | | | | | | | | | | | | | | | | | | |
|---|---|---|---|---|---|---|---|---|---|---|---|---|---|---|---|---|---|---|---|---|---|
| 9 | −1200 | −4812 | −3200 | −2652 | −125 | −1423 | 2232 | −4877 | 933 | −4826 | −3903 | 2660 | −4418 | −21 | −641 | 17 | 1841 | −2737 | −4998 | −1445 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 10 | 2165 | −343 | −7514 | −7608 | −6513 | −1458 | −6467 | −617 | −7212 | −6456 | −5689 | −5927 | −5949 | −6698 | −6869 | 459 | 2825 | 164 | −6903 | −6710 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 11 | −96 | −4819 | −1986 | 3042 | −5139 | −4322 | −1231 | −4889 | 407 | −1250 | −908 | −2958 | −4416 | 1116 | 753 | −1099 | −3287 | −2611 | −5003 | −1094 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 12 | 576 | −4820 | 868 | −576 | −5141 | 247 | −2980 | −4891 | 1644 | −2030 | 1311 | −27 | −4415 | 507 | 425 | −750 | 978 | −1450 | −579 | −14 | 12 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 13 | −651 | −3473 | −5994 | −5358 | 724 | −5197 | −4069 | 1328 | −4954 | 1272 | 2735 | −4843 | −5245 | −4575 | −1903 | −4282 | −919 | 1608 | −3932 | 1598 | 13 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 14 | 3618 | −4903 | −7693 | −8036 | −7579 | −5194 | −6972 | −7248 | −7650 | −7606 | 101 | −6039 | −6011 | −7079 | −7244 | −1632 | −4779 | −2063 | −7833 | −7810 | 14 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 15 | −3348 | −4821 | −474 | 2311 | −1653 | −1203 | 571 | −4893 | 1939 | −4837 | −832 | 573 | −4415 | 1146 | 800 | −1336 | −3287 | −4443 | 714 | −1510 | 15 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 16 | 1579 | −444 | −1236 | 768 | −5127 | −4324 | 154 | −1425 | 573 | −98 | −378 | −1478 | −4417 | 1214 | 1203 | 84 | −311 | −1513 | −4997 | −1652 | 16 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 17 | −287 | −3639 | −6187 | −629 | −398 | −5407 | −4292 | 2532 | −5163 | 1915 | 271 | −5054 | −5444 | −4785 | −4967 | −2123 | −3772 | 857 | −4141 | −3803 | 17 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 18 | 2126 | 1084 | −3242 | 332 | −1672 | 490 | 1044 | −1175 | 694 | −2396 | −3837 | −587 | −4438 | 96 | −207 | −119 | −1565 | −1543 | −249 | −1199 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 19 | 258 | −4831 | 1423 | 2262 | −5152 | −2060 | −2988 | −4902 | 1803 | −4846 | −3920 | −1537 | −4422 | −186 | 1040 | −1113 | −861 | −4453 | −5014 | −4330 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 20 | −355 | −4798 | 8 | 1547 | −5109 | 1942 | −2987 | 460 | −134 | −507 | 42 | −2967 | −4421 | 917 | −454 | −1229 | −697 | −1546 | −4988 | −4312 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 21 | 1715 | −3531 | −6059 | −5425 | 1510 | −668 | −4141 | 1214 | −5023 | 1927 | −435 | −4912 | −5310 | −4642 | −4823 | −2376 | −3650 | −312 | −3998 | −3659 | 21 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −58 | −11295 | −4679 | −894 | −1115 | −701 | −1378 | * | * | | | | | | | | | | | | |
| 22 | −132 | −4768 | −321 | 951 | −5089 | 770 | 489 | −2026 | 1194 | −2667 | 1280 | 326 | −1744 | 667 | 796 | 446 | −436 | −1301 | −4951 | −4269 | 22 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −237 | −11237 | −2725 | −894 | −1115 | −944 | −1058 | * | * | | | | | | | | | | | | |
| 23 | 1160 | −4581 | −94 | 1963 | −4902 | −1249 | −2740 | −2278 | 339 | −2387 | −3670 | −236 | −4175 | 461 | 745 | 1024 | −924 | −1049 | −4764 | −4082 | 23 |
| — | −149 | −500 | 233 | 43 | −381 | 398 | 106 | −626 | 210 | −466 | −721 | 275 | 394 | 45 | 96 | 361 | 117 | −369 | −294 | −249 | |
| C | −135 | −5579 | −3876 | −136 | −3474 | −307 | −2385 | * | * | | | | | | | | | | | | |
| 24 | 1337 | 854 | −1280 | 609 | −5019 | −310 | 1718 | −1938 | 98 | −876 | −731 | −540 | −1814 | 46 | 1357 | 33 | −1515 | −812 | −4884 | 166 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −14 | −11168 | −6765 | −894 | −1115 | −2086 | −388 | * | * | | | | | | | | | | | | |
| 25 | 435 | −4691 | 688 | −398 | −360 | 2718 | −689 | −2278 | −799 | −1227 | −3783 | −961 | −1558 | −1174 | −1563 | −1656 | −1813 | −1398 | −4880 | 337 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −198 | −11173 | −2970 | −894 | −1115 | −1775 | −498 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | −165 | −4348 | −683 | −375 | 2476 | 954 | 1446 | −216 | −603 | 490 | 1726 | −1323 | −1461 | −833 | −1635 | −3038 | −1720 | −3922 | −4588 | −325 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −363 | −11007 | −2172 | −894 | −1115 | −2404 | −302 | * | * | | | | | | | | | | | | |
| 27 | −202 | −4283 | 1293 | 1249 | −4604 | −536 | 499 | −4355 | 755 | −2049 | −3372 | 1215 | −417 | 441 | −192 | 264 | 30 | −256 | −4466 | −3783 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −165 | −10701 | −3220 | −894 | −1115 | −1349 | −719 | * | * | | | | | | | | | | | | |
| 28 | 1807 | −81 | −1952 | −4785 | −1146 | −841 | −3581 | −1117 | −1993 | −259 | −2226 | −4324 | 1029 | −4049 | −4244 | −524 | 399 | 2111 | −3479 | −3135 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10820 | −11862 | −894 | −1115 | −524 | −1715 | * | * | | | | | | | | | | | | |
| 29 | 54 | −4704 | 1543 | 411 | −5025 | −4205 | −2864 | −2691 | 1276 | −1604 | −3793 | −48 | −1871 | 585 | 1321 | −1903 | 792 | 898 | −4888 | −4205 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11168 | −12211 | −894 | −1115 | −116 | −3699 | * | * | | | | | | | | | | | | |
| 30 | −45 | −404 | 335 | 674 | −1451 | −1837 | −3269 | −763 | −710 | 770 | −1367 | −1687 | −747 | −2959 | −788 | −556 | 557 | 1974 | −4526 | −4014 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 31 | −127 | −3535 | −5369 | −1320 | 709 | −5075 | 1250 | 414 | −490 | 180 | 1963 | −1134 | −1821 | −1695 | −1033 | −2289 | −1756 | 2286 | −3981 | 364 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −16 | −11295 | −6544 | −894 | −1115 | −701 | −1378 | * | * | | | | | | | | | | | | |
| 32 | −474 | 2384 | 936 | 331 | −1484 | −2148 | 169 | −4878 | 617 | −4823 | −3896 | 1262 | −1973 | −1046 | 390 | 871 | 511 | 593 | −4990 | −4307 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11279 | −12322 | −894 | −1115 | −427 | −1965 | * | * | | | | | | | | | | | | |
| 33 | 943 | −3459 | −1345 | −5343 | 550 | −1483 | −4054 | 1565 | −4939 | 1120 | 2552 | −4828 | −1873 | −4562 | −4739 | −4267 | −1922 | 1551 | −3919 | −3577 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −11295 | −12337 | −894 | −1115 | −701 | −1378 | * | * | | | | | | | | | | | | |
| 34 | 249 | −4806 | 2083 | −268 | −222 | −1063 | 989 | −1868 | −323 | −1233 | 648 | −6 | 113 | −2527 | −3 | 408 | −745 | −4424 | 55 | 1271 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −11295 | −12337 | −894 | −1115 | −701 | −1378 | * | * | | | | | | | | | | | | |
| 35 | −1706 | −630 | 2301 | 1033 | −969 | −4322 | 1242 | −4891 | −445 | −523 | −262 | 1118 | −858 | 688 | 1100 | −1031 | −1873 | −2254 | −5003 | −4321 | 36 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −11295 | −12337 | −894 | −1115 | −701 | −1378 | * | * | | | | | | | | | | | | |
| 36 | 153 | −3920 | −272 | 194 | 683 | −4727 | −930 | −383 | −1774 | 784 | −680 | −849 | −4803 | −1320 | −1916 | −1517 | −533 | 1792 | −4306 | 2063 | 37 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11295 | −12337 | −894 | −1115 | −701 | −1378 | * | * | | | | | | | | | | | | |
| 37 | 506 | −719 | 2635 | 1241 | −5142 | −4322 | 73 | −4893 | −255 | −2847 | −3910 | 1021 | 401 | −2520 | −1047 | 202 | −843 | −4443 | −5004 | −4321 | 38 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −292 | −11295 | −2450 | −894 | −1115 | −701 | −1378 | * | * | | | | | | | | | | | | |
| 38 | 23 | −4541 | 964 | 1457 | −1216 | −1778 | −2718 | 161 | 707 | −2895 | 590 | −1112 | −163 | −265 | 163 | −951 | −685 | 160 | −4728 | 1536 | 39 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −404 | −11003 | −2038 | −894 | −1115 | −2959 | −199 | * | * | | | | | | | | | | | | |
| 39 | 671 | −4136 | 879 | −518 | −1330 | −334 | −2409 | −1435 | −69 | −1964 | −3235 | −890 | −349 | −1963 | −1050 | 1102 | 1707 | −455 | 1278 | 290 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −644 | −10632 | −1477 | −894 | −1115 | −4916 | −49 | * | * | | | | | | | | | | | | |
| 40 | 371 | 475 | 1463 | 294 | −189 | −3895 | −2734 | −34 | −3314 | 1048 | 1152 | −317 | −3951 | −3037 | −3305 | 782 | −284 | −450 | −2791 | 47 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1908 | −9990 | −449 | −894 | −1115 | −5579 | −31 | * | * | | | | | | | | | | | | |
| 41 | 152 | −3922 | 2729 | 1906 | −4193 | −2325 | −1569 | −4057 | −1651 | −3959 | −3204 | −936 | 1867 | −1211 | −2396 | −1906 | −2224 | −3551 | −4152 | −3235 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −344 | −8091 | −2262 | −894 | −1115 | −4051 | −90 | * | * | | | | | | | | | | | | |
| 42 | −2171 | −3243 | 3385 | 500 | 1178 | −2609 | −1661 | −2854 | −1767 | 87 | −2303 | −1281 | −2976 | −1416 | −2365 | −2050 | −2171 | −2684 | −3156 | −2344 | 43 |
| — | −150 | −501 | 236 | 43 | −375 | 397 | 105 | −627 | 209 | −461 | −722 | 274 | 393 | 44 | 95 | 360 | 116 | −370 | −295 | −247 | |
| G | −3496 | −136 | −9374 | −23 | −5981 | −6114 | −21 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 43 | −1092 | −2568 | 857 | 2428 | −2882 | −2018 | −713 | −2634 | −316 | −669 | −1663 | 736 | −2136 | 737 | −831 | 150 | 469 | −2187 | −2753 | −2063 | 45 |
| — | −150 | −501 | 233 | 42 | −380 | 397 | 105 | −627 | 209 | −467 | −722 | 278 | 393 | 46 | 97 | 360 | 116 | −370 | −295 | −235 | |
| G | −3496 | −136 | −9374 | −23 | −5981 | −728 | −1335 | * | * | | | | | | | | | | | | |
| 44 | 609 | −3125 | −4114 | −16 | 823 | −2153 | −3135 | 1496 | 102 | 878 | −2314 | −3530 | 1121 | −1526 | −70 | −805 | −1556 | 60 | 575 | −3156 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −10683 | −11725 | −894 | −1115 | −1698 | −532 | * | * | | | | | | | | | | | | |
| 45 | −1231 | −4450 | 1071 | 1353 | −4771 | 907 | −2609 | −1640 | 497 | −4466 | −3539 | 1034 | −580 | 1511 | −1038 | 667 | −214 | −1723 | −4633 | −3950 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10888 | −11930 | −894 | −1115 | −107 | −3810 | * | * | | | | | | | | | | | | |
| 46 | −2330 | 218 | 1805 | 1744 | −1257 | −4307 | −899 | −1321 | 447 | 806 | −3894 | 438 | −1655 | 818 | −707 | −431 | −1004 | −4427 | −4989 | −4306 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11279 | −12321 | −894 | −1115 | −1307 | −747 | * | * | | | | | | | | | | | | |
| 47 | −1131 | 407 | −974 | −2279 | 1815 | −2668 | −4026 | 2098 | −978 | 1536 | −154 | −1706 | −1174 | −4525 | −4706 | −4240 | −3552 | 974 | −3899 | −3557 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −18 | −11279 | −6345 | −894 | −1115 | −1307 | −747 | * | * | | | | | | | | | | | | |
| 48 | −168 | −4775 | −166 | 1738 | −5089 | −1832 | −2954 | −1870 | 193 | 682 | 1095 | 155 | 1193 | −794 | −1312 | −1964 | −151 | 48 | −4963 | −562 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −38 | −11261 | −5284 | −894 | −1115 | −819 | −1207 | * | * | | | | | | | | | | | | |
| 49 | −144 | −4772 | 797 | 1558 | −1251 | 624 | 1561 | −4844 | 1261 | −2268 | −3861 | 28 | −4366 | 353 | 178 | −151 | −2 | −2046 | −4956 | −4273 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −114 | −11242 | −3729 | −894 | −1115 | −1116 | −893 | * | * | | | | | | | | | | | | |
| 50 | −390 | −4686 | 916 | 2226 | −452 | −1894 | −971 | −4756 | 630 | −2372 | 492 | −518 | −1700 | −1322 | −1735 | −579 | −1563 | −2146 | 476 | 2346 | 53 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11151 | −12193 | −894 | −1115 | −104 | −3847 | * | * | | | | | | | | | | | | |
| 51 | −20 | −4818 | 1751 | −405 | −5138 | −339 | −2981 | 826 | 476 | −1384 | 1359 | −130 | −703 | 514 | −96 | −78 | 367 | −782 | −5002 | −4320 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 52 | 334 | −1126 | −682 | −1646 | 420 | −252 | 741 | 317 | −623 | 1470 | −3308 | −398 | 293 | −736 | −1640 | −1730 | −1902 | 410 | −175 | 718 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 53 | 716 | 583 | 407 | −798 | −363 | −904 | −4025 | 101 | −1120 | 1363 | −2669 | −4769 | −5210 | −4494 | −1787 | −4239 | −3564 | 2136 | 904 | −3578 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 54 | 270 | −3454 | −5973 | −5337 | −185 | −5175 | −4046 | 1536 | −4932 | 1636 | −692 | −4821 | 124 | −4555 | −1543 | 477 | −1837 | 1179 | 214 | 288 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 55 | −1066 | −3568 | −1832 | −1265 | 2423 | −2435 | −3863 | 1321 | 273 | 547 | −604 | −4412 | 119 | −916 | −1663 | −1855 | −3530 | 1514 | 194 | −3644 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 56 | 262 | 668 | −5970 | −5335 | −116 | 2020 | −4046 | 136 | 447 | −2084 | −1218 | −4820 | −5225 | −4553 | −4731 | −1887 | −1837 | 2301 | −3912 | −504 | 59 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 57 | −549 | 3195 | −1088 | −5330 | −1189 | −1501 | −4045 | 1052 | −4926 | −219 | −322 | −1567 | −617 | −4551 | −4729 | −1747 | 2056 | 1527 | −3912 | −3570 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −57 | −11295 | −4708 | −894 | −1115 | −701 | −1378 | * | * | | | | | | | | | | | | |
| 58 | 1206 | −3457 | −1031 | −2629 | −1462 | −5052 | −3899 | −244 | −4548 | −268 | −2657 | −4551 | 1726 | −4250 | −1889 | 2422 | −3496 | −876 | −3907 | −205 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −335 | −11239 | −2272 | −894 | −1115 | −2195 | −355 | * | * | | | | | | | | | | | | |
| 59 | 277 | −4587 | −6184 | −851 | −7250 | −4814 | −6324 | −7080 | −6904 | −7319 | −6362 | −5415 | 222 | −6325 | −6741 | 107 | 3664 | −5778 | −7459 | −7356 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10904 | −11946 | −894 | −1115 | −4323 | −74 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 60 | −96 | −3112 | −5422 | −1917 | 1768 | −4784 | 1382 | −2608 | −4432 | −219 | 586 | −4370 | −4836 | −1266 | −4296 | −953 | 1402 | −2527 | 3776 | 2543 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −26 | −10904 | −5869 | −894 | −1115 | −4323 | −74 | * | * | | | | | | | | | | | | |
| 61 | −4544 | −5324 | −1483 | −3594 | −4857 | 3367 | −4038 | −5184 | −3903 | −2397 | −262 | 1211 | −5423 | −3871 | −1085 | −4509 | −4551 | −4960 | −5223 | 1306 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −62 | −10880 | −4585 | −894 | −1115 | −718 | −1351 | * | * | | | | | | | | | | | | |
| 62 | −252 | −4407 | 1836 | 1640 | 45 | −4210 | −2881 | −649 | −1211 | −999 | 447 | 1242 | −4300 | 1171 | −2996 | −1044 | −1519 | 254 | −4652 | −733 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11095 | −12137 | −894 | −1115 | −375 | −2128 | * | * | | | | | | | | | | | | |
| 63 | −5759 | −7820 | 580 | 485 | −7995 | 3394 | −4958 | −1075 | −5433 | −7833 | −7300 | −673 | −6078 | −4658 | −6497 | −584 | −5878 | −7421 | −8042 | −6870 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −98 | −11256 | −3931 | −894 | −1115 | −1874 | −460 | * | * | | | | | | | | | | | | |
| 64 | −1043 | −4640 | 2053 | 2292 | −1613 | −2636 | −726 | −355 | −646 | −2179 | −3736 | −2858 | −4305 | 343 | −2967 | 97 | −218 | 100 | −4839 | −279 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11159 | −12201 | −894 | −1115 | −3105 | −178 | * | * | | | | | | | | | | | | |
| 65 | −554 | 864 | −5841 | −1321 | −474 | −5047 | −3918 | 438 | −4801 | 597 | 258 | −4691 | 3184 | −4425 | −4603 | 502 | −1352 | −1269 | −3785 | −3443 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11159 | −12201 | −894 | −1115 | −326 | −2305 | * | * | | | | | | | | | | | | |
| 66 | −3425 | −4573 | −858 | 868 | −4776 | −4437 | −3128 | −1313 | −2782 | −4540 | −3700 | −3134 | 2976 | 837 | −3264 | −1033 | 1869 | 86 | 398 | −4232 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −107 | −11274 | −3814 | −894 | −1115 | −1455 | −655 | * | * | | | | | | | | | | | | |
| 67 | −48 | −3655 | 2215 | 698 | −3661 | −65 | −3489 | 1131 | −3577 | 848 | 789 | −2029 | −1939 | −1263 | −3844 | −1313 | −3352 | −645 | 510 | −185 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −1 | −11168 | −12210 | −894 | −1115 | −3029 | −189 | * | * | | | | | | | | | | | | |
| 68 | −3231 | −4703 | −213 | 582 | −1706 | −1182 | −510 | −4775 | −419 | −959 | −329 | 3063 | −809 | 668 | −1473 | −232 | 830 | −2330 | −4887 | −1301 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −234 | −11168 | −2743 | −894 | −1115 | −3029 | −189 | * | * | | | | | | | | | | | | |
| 69 | 1861 | −110 | −407 | −515 | −1508 | 1408 | −2690 | −1063 | −896 | −1154 | 1872 | 163 | 558 | −1175 | −1391 | −1142 | −2970 | −3974 | −4593 | 44 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10935 | −11977 | −894 | −1115 | −4230 | −79 | * | * | | | | | | | | | | | | |
| 70 | 843 | −4491 | 538 | 1171 | −1272 | −167 | −106 | −4563 | 1452 | −2439 | −961 | −192 | −1108 | 104 | 356 | −1037 | −2958 | 698 | −4675 | −66 | 73 |
| — | −149 | −490 | 232 | 43 | −372 | 395 | 119 | −620 | 207 | −463 | −698 | 272 | 392 | 44 | 92 | 357 | 114 | −368 | −285 | −248 | |
| H | −1280 | −806 | −5941 | −697 | −1384 | −4230 | −79 | * | * | | | | | | | | | | | | |
| 71 | −37 | −4470 | −491 | 149 | 1511 | −1049 | −257 | −4542 | −544 | 819 | −3560 | −421 | 1910 | 154 | 310 | −423 | −150 | −4092 | −4654 | −3971 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10911 | −11953 | −894 | −1115 | −4302 | −75 | * | * | | | | | | | | | | | | |
| 72 | 243 | −4450 | −970 | 385 | 2687 | −3977 | −2637 | −4506 | 366 | 728 | −3542 | −2616 | −720 | −814 | −595 | 294 | 695 | −4067 | −4639 | −1247 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10911 | −11953 | −894 | −1115 | −133 | −3502 | * | * | | | | | | | | | | | | |
| 73 | −722 | 76 | 1077 | 1403 | −809 | −4511 | 985 | −29 | −1050 | −1866 | 139 | −1929 | −1472 | 761 | −3382 | −176 | −1803 | 747 | 2618 | 1333 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11274 | −12316 | −894 | −1115 | −374 | −2132 | * | * | | | | | | | | | | | | |
| 74 | 458 | −4820 | 1671 | 1245 | −1304 | −268 | −869 | −4891 | 312 | −2472 | −3909 | −2957 | −4415 | 848 | 896 | 720 | −1920 | −1819 | 117 | 762 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 75 | −544 | −420 | 1102 | 740 | 2099 | −878 | −518 | −1865 | −390 | 485 | −948 | −1452 | −4682 | −3030 | −1649 | −1961 | −1572 | −1934 | 3836 | −1563 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 76 | 732 | −3465 | −1690 | 220 | 1918 | −555 | −4027 | 1149 | −4859 | 1504 | 1021 | −4774 | −5212 | −1879 | −2347 | −2476 | −1780 | −165 | −3921 | −293 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 77 | −235 | −588 | 1003 | 825 | 737 | −857 | −76 | −42 | −530 | 719 | −1433 | 264 | −480 | 743 | −1698 | −508 | 327 | −2053 | −4985 | −2014 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −15 | −11295 | −6606 | −894 | −1115 | −701 | −1378 | * | * | | | | | | | | | | | | |
| 78 | −941 | −4574 | 240 | 507 | 858 | −189 | −3053 | −514 | −1608 | 1250 | 1478 | 694 | 164 | −606 | −439 | −1974 | −491 | −898 | −4819 | 156 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −49 | −11280 | −4917 | −894 | −1115 | −1267 | −775 | * | * | | | | | | | | | | | | |
| 79 | −827 | −4736 | −481 | 21 | 2357 | −1554 | −996 | −685 | 817 | −408 | −3829 | −837 | −4364 | 635 | 384 | −389 | −1268 | −2074 | 1115 | 1904 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −740 | −11232 | −1318 | −894 | −1115 | −2303 | −327 | * | * | | | | | | | | | | | | |
| 80 | −2645 | −3927 | 174 | −553 | −4173 | 1781 | −203 | 363 | −924 | 175 | 1187 | 239 | −3742 | −1887 | 721 | 273 | −147 | −699 | −4156 | −118 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −278 | −10493 | −2517 | −894 | −1115 | −4284 | −76 | * | * | | | | | | | | | | | | |
| 81 | −2430 | −3729 | −237 | −213 | 24 | −3433 | 620 | 296 | 845 | 1308 | −2836 | −661 | −338 | −595 | −732 | −246 | 382 | 770 | −3954 | −836 | 88 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −10247 | −11289 | −894 | −1115 | −5381 | −35 | * | * | | | | | | | | | | | | |
| 82 | 154 | 217 | 973 | 942 | −4188 | 1130 | −2063 | −3932 | −1649 | −3889 | −2969 | −109 | 2525 | −1607 | −19 | −2311 | −2366 | −1430 | −4066 | 347 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −387 | −10247 | −2094 | −894 | −1115 | −4005 | −93 | * | * | | | | | | | | | | | | |
| 83 | −1006 | −2924 | −656 | −1041 | 270 | −3389 | −2100 | 130 | 740 | 883 | −2083 | 860 | −3471 | −1814 | −2306 | 337 | 2118 | −711 | −3271 | −2775 | 90 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −9941 | −10983 | −894 | −1115 | −5610 | −30 | * | * | | | | | | | | | | | | |
| 84 | 423 | 592 | 213 | 896 | −3948 | −654 | −1791 | −3698 | 978 | −1731 | −2718 | −1768 | −3225 | −1331 | 2670 | 90 | −631 | −3250 | −3812 | −3130 | 91 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −453 | −9941 | −1897 | −894 | −1115 | −5610 | −30 | * | * | | | | | | | | | | | | |
| 85 | −1803 | −3220 | −150 | 121 | 2586 | −2785 | 401 | −3252 | −1036 | −1436 | −2315 | 1315 | −83 | 217 | −1540 | 532 | −370 | −2829 | −3417 | 1886 | 92 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1702 | −9490 | −533 | −894 | −1115 | −5833 | −26 | * | * | | | | | | | | | | | | |
| 86 | −765 | −2123 | −575 | 923 | −2399 | 301 | 2336 | −2118 | −6 | −28 | −1229 | −379 | 1388 | 1363 | −499 | −664 | −706 | −1722 | −2332 | −1678 | 93 |
| — | −157 | −489 | 232 | 32 | −373 | 395 | 92 | −617 | 214 | −466 | −707 | 268 | 381 | 44 | 108 | 386 | 117 | −384 | −301 | −259 | |
| . | −2962 | −412 | −3059 | −5165 | −41 | −6177 | −20 | * | * | | | | | | | | | | | | |
| 87 | −787 | −2228 | 2023 | 1072 | −2525 | 448 | −399 | −2266 | −31 | −2236 | −1339 | −299 | −1807 | 42 | 1169 | −661 | −736 | 416 | −2426 | −1740 | 142 |
| — | −149 | −500 | 232 | 43 | −381 | 398 | 105 | −627 | 210 | −466 | −721 | 275 | 393 | 48 | 97 | 360 | 121 | −370 | −295 | −250 | |
| . | −2781 | −442 | −3079 | −46 | −5006 | −4458 | −67 | * | * | | | | | | | | | | | | |
| 88 | −818 | −2136 | 736 | −162 | 357 | −1801 | −479 | −2105 | 741 | −504 | −1245 | 1806 | −1901 | −44 | −590 | 1615 | −759 | −1726 | −2357 | −1710 | 144 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −533 | −7959 | −1714 | −894 | −1115 | −1867 | −462 | * | * | | | | | | | | | | | | |
| 89 | −711 | −3347 | 1684 | 1411 | 741 | −822 | 552 | −611 | −129 | −1283 | −2437 | 540 | 585 | −1058 | −1606 | 269 | 119 | −2967 | −3532 | −2852 | 145 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −3 | −9600 | −10642 | −894 | −1115 | −5020 | −45 | * | * | | | | | | | | | | | | |
| 90 | 356 | −3391 | 1298 | 1509 | −564 | −203 | −1553 | −3461 | −1134 | −3407 | −2481 | −1528 | −2987 | 682 | −312 | 635 | 1783 | −3012 | −3575 | −2893 | 146 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −3 | −9641 | −10683 | −894 | −1115 | −5769 | −27 | * | * | | | | | | | | | | | | |
| 91 | −785 | −2008 | 700 | 1077 | 35 | −3648 | −2504 | 376 | −3227 | 2022 | 1659 | −3194 | −3701 | −2904 | −3130 | −683 | −2074 | −164 | −2462 | −2113 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −3 | −9641 | −10683 | −894 | −1115 | −2059 | −396 | * | * | | | | | | | | | | | | |
| 92 | −1220 | −3861 | 1380 | 1851 | −4182 | 149 | −2021 | −213 | 1139 | −1689 | −2950 | −474 | −3455 | −331 | −507 | 610 | 127 | −1563 | −4044 | −3362 | 148 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −2 | −10217 | −11259 | −894 | −1115 | −868 | −1145 | * | * | | | | | | | | | | | | |
| 93 | 1343 | −4459 | 1516 | 989 | 195 | 1221 | −2620 | −733 | −1132 | −1337 | −3549 | 405 | −1697 | −70 | −667 | −639 | −1440 | −4081 | −4643 | −3961 | 149 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −218 | −10900 | −2837 | −894 | −1115 | −4336 | −73 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 94 | 303 | −283 | 376 | −1053 | −4156 | 1709 | −2541 | 610 | −465 | −838 | −972 | −848 | 1084 | −92 | −2667 | −1467 | 605 | −81 | −4222 | −870 | 150 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10683 | −11725 | −894 | −1115 | −4829 | −52 | * | * | | | | | | | | | | | | |
| 95 | 41 | −4266 | 2251 | −558 | −403 | 418 | −2426 | −4336 | 435 | −1192 | −3355 | −440 | 1126 | 49 | −304 | −306 | −2733 | −3887 | 1790 | 94 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10683 | −11725 | −894 | −1115 | −2332 | −319 | * | * | | | | | | | | | | | | |
| 96 | −518 | −3014 | −5471 | −4837 | 2206 | −4721 | −233 | −1119 | −1282 | 2485 | 486 | −4348 | −4771 | −432 | −76 | −3803 | −3120 | −1350 | −3470 | −3127 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10809 | −11851 | −894 | −1115 | −1597 | −579 | * | * | | | | | | | | | | | | |
| 97 | −2 | 614 | −1207 | 684 | −174 | 223 | −2690 | −1428 | 1052 | −4546 | −3619 | 313 | 395 | 728 | −2778 | 1695 | 262 | −4152 | −4714 | −4031 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −54 | −10978 | −4773 | −894 | −1115 | −606 | −1544 | * | * | | | | | | | | | | | | |
| 98 | −654 | −902 | −166 | −2517 | −4995 | 2294 | −476 | −4743 | 136 | −829 | −599 | 2160 | −4283 | 763 | −1323 | −550 | −715 | −2086 | −4864 | −4184 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11149 | −12191 | −894 | −1115 | −279 | −2507 | * | * | | | | | | | | | | | | |
| 99 | −1913 | 48 | −2262 | −5092 | 398 | −2743 | −3980 | −577 | 1652 | 1018 | 1534 | −294 | −1079 | −4404 | −236 | −1615 | −411 | 1505 | −3919 | 415 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11277 | −12319 | −894 | −1115 | −1375 | −702 | * | * | | | | | | | | | | | | |
| 100 | 46 | −742 | −283 | −907 | −5125 | −717 | −841 | −2230 | 1734 | −1827 | −3893 | −324 | 418 | −414 | 2087 | 116 | 894 | −4426 | −4987 | −4305 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −16 | −11277 | −6526 | −894 | −1115 | −1375 | −702 | * | * | | | | | | | | | | | | |
| 101 | 12 | −291 | −5625 | −5008 | 2183 | −1689 | −3950 | −305 | 307 | −1873 | −2661 | −1311 | −5149 | −1302 | −353 | −737 | −1729 | 1469 | −3912 | 2854 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −58 | −11261 | −4692 | −894 | −1115 | −909 | −1097 | * | * | | | | | | | | | | | | |
| 102 | 2482 | 596 | −5493 | −4882 | −3397 | 967 | −3892 | −1018 | −4558 | −915 | −2636 | −1759 | −904 | 1465 | −4497 | 112 | −1023 | −437 | −3887 | −887 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11221 | −12263 | −894 | −1115 | −493 | −1789 | * | * | | | | | | | | | | | | |
| 103 | 394 | 1696 | −5956 | −5320 | −301 | −941 | −4029 | −461 | −4915 | 818 | 1333 | −4804 | −5208 | −4538 | −4715 | −1864 | −3551 | 2592 | 1369 | 592 | 159 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11277 | −12319 | −894 | −1115 | −1375 | −702 | * | * | | | | | | | | | | | | |
| 104 | −591 | −3440 | −5930 | −5295 | 3519 | −2085 | −4024 | −547 | 271 | 913 | −2643 | −4792 | −5205 | −4524 | −250 | −823 | −3550 | −68 | −3897 | −1275 | 160 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11277 | −12319 | −894 | −1115 | −1375 | −702 | * | * | | | | | | | | | | | | |
| 105 | 1673 | −4794 | −7480 | −7642 | −6858 | 3113 | −6601 | −2108 | −7283 | −6844 | −6018 | −5927 | −5947 | −1705 | −6952 | −2265 | −81 | 22 | −7196 | −7045 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11277 | −12319 | −894 | −1115 | −1375 | −702 | * | * | | | | | | | | | | | | |
| 106 | −1437 | 2582 | −5958 | −5322 | 2404 | −1000 | −4031 | −1596 | −4917 | 2243 | −2642 | −4806 | −5209 | −4540 | −4717 | 72 | −1002 | −1632 | 220 | −3555 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11277 | −12319 | −894 | −1115 | −1375 | −702 | * | * | | | | | | | | | | | | |
| 107 | −5350 | −5040 | −7255 | −6910 | −602 | 3439 | −4278 | −421 | −6497 | −2611 | −4284 | −5965 | −1531 | −5863 | −6187 | −1138 | −5289 | −4587 | 2423 | 423 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11277 | −12319 | −894 | −1115 | −1375 | −702 | * | * | | | | | | | | | | | | |
| 108 | −2325 | −6477 | 3321 | −1761 | −6786 | −660 | −696 | −6619 | −4228 | −6531 | −5717 | 1169 | −5546 | −3897 | −4897 | 1693 | −1638 | −2291 | −6713 | −5865 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11277 | −12319 | −894 | −1115 | −1375 | −702 | * | * | | | | | | | | | | | | |
| 109 | −2338 | −4652 | −3268 | −2718 | 0 | −1846 | 1392 | −1647 | 457 | −4639 | 604 | −1593 | −4442 | 1705 | 1220 | 2006 | −573 | −4238 | 2045 | 872 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11277 | −12319 | −894 | −1115 | −1375 | −702 | * | * | | | | | | | | | | | | |
| 110 | 724 | −4766 | −133 | 611 | −5069 | 1416 | −2976 | −2560 | −2563 | −910 | 331 | −284 | −4408 | −31 | −1761 | 1003 | 1476 | −598 | −4960 | −4288 | 166 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11277 | −12319 | −894 | −1115 | −1375 | −702 | * | * | | | | | | | | | | | | |

-continued

| | | | | | | | | | | | | | | | | | | | | |
|---|---|---|---|---|---|---|---|---|---|---|---|---|---|---|---|---|---|---|---|---|
| 111 | −4724 | −5226 | −749 | −4400 | −4494 | 1725 | −4575 | −5221 | −5121 | −2291 | −4786 | −131 | −5866 | −4717 | −5521 | −1358 | −1300 | −5004 | 3766 | 3785 | 167 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −38 | −11277 | −5281 | −894 | −1115 | −1375 | −702 | * | * | | | | | | | | | | | | |
| 112 | −336 | −4768 | −876 | 1682 | −5088 | 787 | −2929 | −4839 | −411 | −2246 | −1012 | −650 | 1369 | −516 | −1538 | −61 | −128 | −1352 | 1020 | 2053 | 168 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1 | −11239 | −12281 | −894 | −1115 | −2186 | −358 | * | * | | | | | | | | | | | | |
| 113 | −716 | −4755 | −3151 | −332 | 465 | 892 | 2352 | −4816 | 320 | 183 | −3846 | 144 | 971 | 133 | −1909 | −102 | −56 | −1765 | −4943 | 1106 | 169 |
| — | −148 | −487 | 233 | 44 | −382 | 399 | 104 | −623 | 213 | −467 | −710 | 274 | 392 | 44 | 97 | 359 | 116 | −371 | −296 | −251 | |
| T | −2844 | −4474 | −294 | −1874 | −460 | −2186 | −358 | * | * | | | | | | | | | | | | |
| 114 | −2174 | −3749 | 2575 | 2167 | −4022 | −2718 | 1575 | −3810 | 177 | 498 | −2886 | −1330 | −3010 | −1256 | −2008 | −1980 | −2149 | −3353 | −3916 | −3151 | 175 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −5 | −8801 | −9843 | −894 | −1115 | −3597 | −124 | * | * | | | | | | | | | | | | |
| 115 | −1729 | −3092 | −1558 | 735 | −3344 | −2688 | −1344 | −3100 | 995 | −3085 | −2196 | 2243 | −2788 | −904 | −1369 | −1626 | 2139 | −2700 | 1567 | 1652 | 176 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | −9201 | −10243 | −894 | −1115 | −786 | −1251 | * | * | | | | | | | | | | | | |
| 116 | −7339 | −6286 | −7749 | −8107 | 4259 | −1841 | −3824 | −6252 | −7665 | −5553 | 82 | −6244 | −7478 | −6387 | −7027 | −6864 | −7205 | −6413 | −3071 | 2358 | 177 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −10733 | −11775 | −894 | −1115 | −2257 | −339 | * | * | | | | | | | | | | | | |
| 117 | −381 | 4555 | −5199 | −4590 | −3068 | −441 | −314 | −895 | −4257 | −651 | −2308 | 2154 | −4769 | 1263 | −4183 | −3780 | −3153 | −433 | −3559 | −3208 | 178 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −10854 | −11896 | −894 | −1115 | −41 | −5141 | * | * | | | | | | | | | | | | |
| 118 | 815 | 239 | 378 | 535 | −379 | 1121 | −2983 | −4877 | 240 | −2295 | −466 | 352 | −1476 | −505 | −442 | −956 | −1696 | −2157 | 3342 | 830 | 179 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 119 | 2470 | −3511 | −5518 | −4909 | 1247 | −340 | −3950 | 338 | −2528 | −3363 | 847 | −424 | −1189 | 308 | −2577 | −1325 | −1131 | 125 | 1551 | −1249 | 180 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 120 | 1225 | −3633 | −4892 | −411 | −1094 | 1260 | −343 | 361 | −1660 | −1384 | 1903 | −4233 | 155 | −620 | −4233 | −279 | −203 | 1264 | −4065 | −3686 | 181 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 121 | −2149 | −4818 | 1163 | −1675 | −956 | 1414 | 1140 | −304 | 2075 | −2297 | −3908 | −1361 | −1895 | −5 | 1573 | −2169 | −3287 | −1366 | −5002 | −4320 | 182 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 122 | 1057 | −4802 | 122 | −53 | 145 | −2817 | −738 | −192 | 1515 | −650 | 806 | −1358 | −2129 | 592 | 94 | −1654 | 649 | −1373 | −4991 | 681 | 183 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 123 | −555 | −4905 | −7602 | −6994 | 1402 | −6955 | −5820 | 1829 | −6652 | 1937 | 640 | −6615 | −6752 | −6054 | −6390 | −6097 | −5141 | 1680 | 1003 | −5134 | 184 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 124 | −583 | −4818 | 2583 | 1674 | −893 | −2187 | 1338 | −506 | −47 | −4833 | −3907 | −844 | −4415 | 64 | −1274 | −1244 | −3287 | −832 | 380 | 723 | 185 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 125 | 0 | −4821 | 717 | 1817 | −1293 | 815 | −567 | −4893 | 1267 | −2751 | −3910 | 610 | −4415 | 435 | −166 | −494 | 97 | −2139 | −5004 | −4321 | 186 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 126 | −751 | −4287 | −2311 | −1113 | −988 | −1448 | −767 | 140 | 2152 | 16 | 1090 | −3289 | −4602 | −168 | 2157 | −3454 | −584 | −1332 | 1615 | −4065 | 187 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 127 | −519 | −311 | −5982 | −5347 | 842 | −5185 | −4056 | 822 | −4942 | 2487 | 579 | −4831 | −1159 | −4564 | −4741 | −4270 | −919 | 557 | −3921 | 104 | 188 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 128 | 983 | −4820 | −1323 | 1239 | −876 | 18 | −2980 | −2395 | 1098 | −2811 | −3909 | −1375 | −4415 | 1694 | −716 | 1035 | 327 | −1181 | −5003 | −4321 | 189 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −18 | −11295 | −6419 | −894 | −1115 | −701 | −1378 | * | * | | | | | | | | | | | | |
| 129 | 694 | −4806 | 850 | 2038 | −1284 | 887 | −1152 | −4877 | 49 | −2614 | −3895 | −4 | −1478 | 625 | −47 | 80 | −1826 | −4428 | −4989 | −869 | 190 |
| — | −149 | −500 | 233 | 43 | −381 | 398 | 105 | −627 | 210 | −466 | −721 | 275 | 393 | 45 | 96 | 361 | 117 | −370 | −295 | −243 | |
| T | −51 | −4852 | −12320 | −74 | −4316 | −1332 | −731 | * | * | | | | | | | | | | | | |
| 130 | 465 | −880 | −5817 | −5190 | −1157 | −1911 | −1277 | −844 | 91 | 2253 | −904 | −4740 | −5190 | 396 | 630 | −1403 | −990 | 243 | −3909 | −1119 | 192 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11278 | −12320 | −894 | −1115 | −412 | −2009 | * | * | | | | | | | | | | | | |
| 131 | −2322 | −4951 | −6302 | −6399 | 1425 | 3445 | −6150 | −6753 | −179 | −6985 | −680 | −1547 | −5957 | −6081 | −6182 | −922 | −4761 | −5856 | −7198 | −6929 | 193 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11295 | −12337 | −894 | −1115 | −701 | −1378 | * | * | | | | | | | | | | | | |
| 132 | 2523 | 671 | −5964 | −5328 | 1501 | 1324 | −4045 | −1379 | −824 | −2001 | −453 | −4817 | −2186 | −4550 | −4728 | −1720 | −949 | 188 | −3913 | −1807 | 194 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 133 | −1111 | −828 | 452 | 1395 | −5141 | −4322 | −2980 | −1090 | 1646 | −3167 | −3910 | −5 | −4415 | 837 | 640 | 1053 | 780 | −930 | −5004 | −4321 | 195 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 134 | −840 | −3508 | −5540 | −4930 | 556 | −5107 | −726 | 588 | −2114 | −1125 | 609 | −984 | −5162 | −529 | 2461 | −656 | 1309 | 1391 | −3958 | −3605 | 196 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 135 | −885 | −3454 | −5970 | −2303 | 537 | 594 | −4046 | 1779 | −4929 | 1275 | −751 | −4820 | −1735 | −1386 | −4731 | −1560 | −845 | 1852 | −3912 | −1115 | 197 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 136 | −200 | 1350 | −313 | 32 | 963 | 1547 | −3505 | −1066 | −1482 | 478 | −143 | −1421 | −4831 | −747 | −3804 | 80 | 903 | −197 | −4272 | −1167 | 198 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −949 | −11295 | −1054 | −894 | −1115 | −701 | −1378 | * | * | | | | | | | | | | | | |
| 137 | −499 | −3965 | 1107 | 299 | −213 | −1315 | 1058 | −4030 | −1716 | −936 | −3055 | −169 | 1635 | 1254 | −896 | −96 | 367 | −363 | −4150 | 923 | 199 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −725 | −10347 | −1342 | −894 | −1115 | −5285 | −37 | * | * | | | | | | | | | | | | |
| 138 | −1935 | −3291 | −1821 | −262 | −3572 | 505 | −1589 | −3291 | 1114 | −3292 | −2398 | −1579 | 386 | −1146 | −1679 | 740 | 1000 | −2893 | 4315 | 554 | 200 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −987 | −9624 | −1017 | −894 | −1115 | −5777 | −27 | * | * | | | | | | | | | | | | |
| 139 | −1644 | 1961 | −4471 | −4401 | −3885 | 694 | −3640 | 234 | −4121 | −3840 | −3054 | −3176 | 3467 | −3740 | −3982 | 815 | −2044 | −2846 | −4240 | −4010 | 201 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −399 | −8643 | −2066 | −894 | −1115 | −6063 | −22 | * | * | | | | | | | | | | | | |
| 140 | 286 | −1802 | −1620 | −1088 | −2095 | −2217 | −1137 | 68 | −864 | −1912 | −1161 | 726 | −2400 | −853 | 597 | −1247 | 2947 | −1439 | −2335 | −1858 | 202 |
| — | −146 | −501 | 237 | 49 | −382 | 398 | 105 | −627 | 211 | −467 | −721 | 274 | 393 | 44 | 95 | 358 | 116 | −370 | −295 | −250 | |
| T | −3416 | −144 | −9294 | −24 | −5896 | −6125 | −21 | * | * | | | | | | | | | | | | |
| 141 | −4634 | −4362 | −5271 | −5643 | −6049 | 3838 | −5183 | −6808 | −5939 | −6455 | −6144 | −5328 | −4954 | −5722 | −5542 | −4932 | −5011 | −6052 | −5054 | −6011 | 204 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −7 | −8252 | −9294 | −894 | −1115 | −6125 | −21 | * | * | | | | | | | | | | | | |
| 142 | −5251 | −4321 | −5335 | −5670 | −1246 | −4878 | −2603 | −4842 | −5494 | −4203 | −4272 | −4642 | −5130 | −4770 | −5017 | −5137 | −5295 | −4917 | −1898 | 4887 | 205 |
| — | −150 | −501 | 237 | 47 | −382 | 399 | 113 | −627 | 211 | −467 | −721 | 276 | 393 | 44 | 95 | 358 | 116 | −370 | −295 | −250 | |
| — | −3416 | −144 | −9294 | −24 | −5896 | −6125 | −21 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 143 | −4755 | −3874 | −5104 | −5403 | 4356 | −5008 | 1664 | −3856 | −5016 | −3196 | −3270 | −3876 | −4993 | −3998 | −4513 | −4423 | −4684 | −4003 | −845 | 338 | 207 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −7 | −8252 | −9294 | −894 | −1115 | −6125 | −21 | * | * | | | | | | | | | | | | |
| 144 | −1644 | −3218 | 616 | 2438 | −3514 | −2233 | −1171 | −3304 | −949 | −3234 | −2365 | 1424 | −2512 | −755 | −1535 | 1447 | 596 | −2836 | −3411 | −2644 | 208 |
| — | −144 | −501 | 235 | 46 | −379 | 399 | 105 | −627 | 209 | −467 | −721 | 274 | 393 | 44 | 95 | 359 | 116 | −370 | −295 | −250 | |
| S | −3416 | −144 | −9294 | −24 | −5896 | −6125 | −21 | * | * | | | | | | | | | | | | |
| 145 | −1611 | −2219 | −3630 | −3929 | −4621 | −2432 | −3739 | −4573 | −4138 | −4776 | −3889 | −2975 | 924 | −3748 | −4032 | 3486 | −2071 | −3374 | −4741 | −4621 | 210 |
| — | −148 | −501 | 232 | 42 | −382 | 398 | 105 | −627 | 220 | −465 | −721 | 274 | 393 | 44 | 95 | 359 | 118 | −370 | −295 | −250 | |
| T | −3416 | −144 | −9294 | −24 | −5896 | −6125 | −21 | * | * | | | | | | | | | | | | |
| 146 | 3294 | −1989 | −3961 | −4221 | −4548 | 214 | −3749 | −4352 | −4243 | −4605 | −3672 | −2915 | 913 | −3769 | −4052 | −1622 | −1840 | −3136 | −4748 | −4663 | 212 |
| — | −149 | −500 | 232 | 43 | −381 | 398 | 105 | −624 | 210 | −462 | −721 | 275 | 393 | 45 | 95 | 359 | 117 | −368 | −295 | −250 | |
| E | −538 | −1692 | −9294 | −409 | −2019 | −6125 | −21 | * | * | | | | | | | | | | | | |
| 147 | 926 | −1394 | −3370 | −126 | −1427 | −3062 | −2047 | −225 | −2589 | 1501 | −564 | −2583 | −3128 | −2321 | −2573 | −2173 | −1485 | 2379 | −2058 | −1705 | 215 |
| — | −150 | −501 | 235 | 48 | −382 | 398 | 105 | −627 | 210 | −467 | −721 | 274 | 393 | 44 | 99 | 358 | 116 | −366 | −295 | −250 | |
| E | −3416 | −144 | −9294 | −24 | −5896 | −6125 | −21 | * | * | | | | | | | | | | | | |
| 148 | −2738 | −4734 | 2467 | 812 | −4882 | 1851 | −1969 | −4844 | −2308 | −4690 | −4070 | 2513 | −3129 | −1649 | −3248 | −2367 | −2823 | −4294 | −4891 | −3805 | 217 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −7 | −8252 | −9294 | −894 | −1115 | −6125 | −21 | * | * | | | | | | | | | | | | |
| 149 | −2572 | −4418 | 1672 | −744 | −4666 | 2777 | −1881 | −4585 | −2104 | −4457 | −3776 | 1664 | −3060 | 1210 | −2939 | −2246 | −2644 | −4049 | −4649 | −3646 | 218 |
| — | −150 | −501 | 232 | 45 | −382 | 398 | 108 | −627 | 216 | −465 | −721 | 274 | 393 | 46 | 97 | 358 | 118 | −370 | −295 | −250 | |
| E | −3416 | −144 | −9294 | −24 | −5896 | −4909 | −49 | * | * | | | | | | | | | | | | |
| 150 | −3016 | −3173 | −4871 | −5066 | 4263 | −3788 | −2574 | −3260 | −4824 | −2965 | −2925 | −3880 | −4307 | −4201 | −4502 | −3242 | 1122 | −3238 | −1973 | −877 | 220 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −6 | −8441 | −9483 | −894 | −1115 | −1035 | −966 | * | * | | | | | | | | | | | | |
| 151 | −426 | −4060 | 934 | 1324 | −4381 | −1586 | 1045 | −1828 | 374 | −2138 | −3149 | −37 | 1961 | −564 | −1181 | −580 | −2526 | 1176 | −4243 | −3561 | 221 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −2 | −10448 | −11490 | −894 | −1115 | −2656 | −249 | * | * | | | | | | | | | | | | |
| 152 | −617 | −2808 | −5315 | −4680 | −410 | 1266 | −3397 | −1091 | −1626 | 1302 | 1729 | −4169 | −4577 | −3902 | 1030 | −3611 | 538 | 1229 | −3266 | 174 | 222 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −10598 | −11640 | −894 | −1115 | −29 | −5647 | * | * | | | | | | | | | | | | |
| 153 | −820 | 414 | −5724 | −2346 | −634 | 2372 | 702 | −1428 | −4750 | 1512 | −2684 | −1555 | −1896 | −1681 | −2187 | −4212 | −119 | 579 | −3936 | −3589 | 223 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 154 | 323 | 726 | −522 | 1736 | −5124 | 790 | −610 | −4871 | 1069 | 407 | −258 | −2962 | −2128 | −1327 | −330 | −1885 | −28 | −373 | −4995 | −378 | 224 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 155 | 586 | 970 | −6113 | −5485 | −1599 | 2350 | −4214 | 1774 | −5087 | −387 | 371 | −4975 | −5372 | −4714 | −4892 | −4418 | −1814 | 1285 | −4074 | −3730 | 225 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1 | −11295 | −12337 | −894 | −1115 | −701 | −1378 | * | * | | | | | | | | | | | | |
| 156 | −1345 | −398 | 3271 | −501 | −5142 | −1856 | −271 | −4892 | 685 | −2497 | −3910 | 52 | −4415 | 1166 | −398 | −1644 | −3287 | −1313 | −5004 | −1418 | 226 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1 | −11295 | −12337 | −894 | −1115 | −701 | −1378 | * | * | | | | | | | | | | | | |
| 157 | 124 | −4164 | 1739 | 2217 | 215 | 200 | −3285 | −889 | −3063 | −612 | −677 | −698 | −4661 | 136 | −1356 | −3526 | −1683 | −822 | 89 | 125 | 227 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −90 | −11295 | −4057 | −894 | −1115 | −701 | −1378 | * | * | | | | | | | | | | | | |
| 158 | 433 | −4738 | 1835 | −618 | −5059 | −501 | −402 | −2555 | 128 | 48 | 453 | 73 | −1387 | 1673 | −680 | −19 | 86 | −878 | −4922 | −4239 | 228 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −21 | −11206 | −6172 | −894 | −1115 | −1651 | −553 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 159 | −140 | 1738 | 537 | −66 | −5056 | −828 | 1369 | −4806 | −2479 | −2504 | 156 | 1525 | 1885 | −549 | −404 | −2201 | 1507 | −4358 | −4920 | −482 | 229 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −378 | −11206 | −2121 | −894 | −1115 | −1666 | −546 | * | * | | | | | | | | | | | | |
| 160 | 399 | −4417 | −491 | 169 | −4737 | 434 | 482 | −265 | −609 | −1355 | −265 | −1134 | 663 | 1825 | −820 | 813 | 257 | −271 | −4601 | −3919 | 230 |
| — | −150 | −505 | 235 | 49 | −382 | 398 | 107 | −629 | 207 | −463 | −720 | 273 | 397 | 51 | 91 | 360 | 116 | −374 | −291 | −246 | |
| G | −2415 | −592 | −2746 | −6 | −8014 | −3465 | −137 | * | * | | | | | | | | | | | | |
| 161 | −151 | −4220 | 2090 | 1593 | −4532 | −249 | −2403 | −1671 | −1987 | −2223 | −254 | 529 | −587 | −376 | −2493 | 444 | 814 | −1548 | −4408 | −865 | 232 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1 | −10651 | −11693 | −894 | −1115 | −200 | −2951 | * | * | | | | | | | | | | | | |
| 162 | 517 | 358 | 1524 | 1187 | −5065 | 1447 | −781 | −2082 | −1567 | 327 | −30 | 396 | −4362 | −1279 | −3018 | −920 | 296 | −4369 | −4938 | −4259 | 233 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11234 | −12276 | −894 | −1115 | −636 | −1488 | * | * | | | | | | | | | | | | |
| 163 | −947 | −4100 | −271 | 94 | 99 | −4584 | −828 | 937 | −750 | 1028 | 1258 | −1492 | −178 | 1571 | −3506 | −2121 | 927 | −1923 | −84 | 873 | 234 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11274 | −12316 | −894 | −1115 | −377 | −2120 | * | * | | | | | | | | | | | | |
| 164 | −446 | −4818 | 1297 | 2562 | −1646 | −4322 | −2981 | −1112 | 352 | −1938 | −657 | −1755 | −1130 | 405 | 32 | −412 | 207 | −2139 | −5002 | −4320 | 235 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 165 | 469 | −4821 | 1022 | 2038 | −5142 | −89 | −2980 | −4892 | 159 | −1010 | −624 | −1846 | −367 | 1025 | −637 | −310 | 524 | −2350 | −5004 | −1798 | 236 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −39 | −11295 | −5249 | −894 | −1115 | −701 | −1378 | * | * | | | | | | | | | | | | |
| 166 | 1234 | 2147 | 1416 | 122 | −2091 | −2027 | −848 | −711 | −2746 | 89 | 419 | −1082 | −1020 | −645 | 1085 | −532 | −1137 | −312 | −4706 | −1276 | 237 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11256 | −12299 | −894 | −1115 | −873 | −1139 | * | * | | | | | | | | | | | | |
| 167 | 655 | 1793 | −5947 | −1183 | 2523 | −5156 | −4027 | 445 | −2303 | −99 | −418 | −4799 | −5206 | −4532 | 646 | −753 | −1295 | 1118 | −3894 | 1061 | 238 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11275 | −12317 | −894 | −1115 | −1410 | −681 | * | * | | | | | | | | | | | | |
| 168 | 323 | −689 | −1 | 1811 | −5117 | −4305 | 2159 | −134 | 401 | −570 | −151 | −565 | −4398 | −692 | 1431 | −197 | −1609 | −1720 | −4983 | −4301 | 239 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11275 | −12317 | −894 | −1115 | −387 | −2087 | * | * | | | | | | | | | | | | |
| 169 | 1310 | −4819 | −1254 | 926 | −272 | −1204 | 2212 | −640 | 320 | −1086 | −3908 | −1360 | 621 | 456 | −1637 | 312 | 91 | −4440 | 138 | −1285 | 240 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1 | −11295 | −12337 | −894 | −1115 | −701 | −1378 | * | * | | | | | | | | | | | | |
| 170 | −2127 | −4412 | −6961 | −6419 | 983 | 1772 | −4829 | −757 | −6037 | −2221 | −3301 | −5818 | −6192 | −5563 | −5807 | −5294 | −4590 | −1837 | 5535 | −3791 | 241 |
| — | * | * | * | * | * | * | * | * | * | * | * | * | * | * | * | * | * | * | * | * | |
| H | * | * | * | * | * | * | * | * | 0 | | | | | | | | | | | | |
| // | | | | | | | | | | | | | | | | | | | | | |

| HMMER2.0 | [2.3.2] |
|---|---|
| NAME | Glyco__transf__20 |
| ACC | PF00982.13 |
| DESC | Glycosyltransferase family 20 |
| LENG | 514 |
| ALPH | Amino |
| RF | no |
| CS | yes |
| MAP | yes |
| COM | hmmbuild -F HMM__ls.ann SEED.ann |
| COM | hmmcalibrate --seed 0 HMM__ls.ann |
| NSEQ | 23 |
| DATE | Tue Apr 22 16:21:19 2008 |
| CKSUM | 257 |
| GA | −243.6000 −243.6000; |
| TC | −243.2000 −243.2000; |
| NC | −245.0000 −245.0000; |
| XT | −8455 −4 −1000 −1000 −8455 −4 −8455 −4 |
| NULT | −4 −8455 |
| NULE | 595 −1558 85 338 −294 453 −1158 197 249 902 −1085 −142 −21 −313 45 531 201 384 −1998 −644 |
| EVD | −381.697144 0.102587 |

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | −100 | * | −3906 | | | | | | | | | | | | | | | | | | |
| 1 | −692 | −2874 | −154 | 374 | −3193 | 703 | 379 | −2942 | 459 | -838 | −1963 | −1015 | 1186 | 846 | −1126 | 1585 | −1344 | −2495 | −3058 | 523 | 1 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | −100 | * | | | | | | | | | | | | |
| 2 | −1658 | −3135 | 240 | 287 | −3462 | −2546 | −1239 | −3210 | 1632 | −3142 | −2232 | 1748 | −2674 | −788 | 2524 | 296 | −1598 | −2762 | −3299 | −2620 | 2 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 3 | −1489 | −1996 | 55 | −1439 | 1414 | −2692 | −1422 | −347 | 218 | 1289 | −1165 | −1609 | 81 | 552 | −255 | 495 | −1429 | 708 | −2370 | −1909 | 3 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 4 | −1921 | −1718 | −4256 | −3645 | −1688 | 33 | 2091 | 1705 | −3262 | 1487 | -876 | −3165 | −3556 | −2901 | −3086 | −2625 | −1866 | 2006 | −2283 | −1939 | 4 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 5 | −2001 | −1811 | −4353 | −3770 | −1908 | 771 | −2628 | 2268 | −3411 | -860 | −1081 | −3288 | −3675 | −3070 | −3259 | −455 | 92 | 2429 | −2504 | −2150 | 5 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 6 | −2849 | −2511 | −5254 | −4730 | 409 | −4668 | −3452 | 577 | −4418 | −158 | −1325 | −4275 | −4564 | −3982 | −4242 | −3826 | −2797 | 3300 | −3022 | 1229 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 7 | 1227 | −2892 | −2002 | 97 | −3869 | 405 | −2217 | −3596 | −2012 | −3696 | −2854 | −1975 | −3196 | −1861 | −2477 | 2789 | −2100 | −3073 | −3954 | 732 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −4 | -8959 | −10001 | -894 | −1115 | −701 | −1378 | * | * | | | | | | | | | | | | |
| 8 | −1663 | −2284 | −2011 | −1523 | −2330 | −351 | 1216 | −2040 | −1373 | −2266 | 1018 | 3538 | −2904 | −1324 | −1737 | −1783 | 125 | −1840 | 1872 | −2101 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | -80 | -8959 | −4259 | -894 | −1115 | −701 | −1378 | * | * | | | | | | | | | | | | |

-continued

| | | | | | | | | | | | | | | | | | | | | |
|---|---|---|---|---|---|---|---|---|---|---|---|---|---|---|---|---|---|---|---|---|
| 9 | −1659 | −2996 | −1580 | −988 | −537 | −2612 | −1187 | −3026 | 957 | −2977 | 327 | 994 | −2690 | 1014 | 3048 | −1554 | 146 | −2630 | −3132 | −2537 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | -8883 | -9925 | -894 | −1115 | −1271 | −772 | * | * | | | | | | | | | | | | |
| 10 | −386 | −1546 | −3183 | −158 | −1549 | 1087 | −1902 | 1844 | −2408 | 1816 | −774 | −2433 | −3085 | −2148 | −2442 | −543 | −1525 | −967 | −2028 | −1666 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | -8883 | -9925 | -894 | −1115 | −1271 | −772 | * | * | | | | | | | | | | | | |
| 11 | −190 | −2861 | 310 | 350 | −3154 | −2399 | −1092 | −191 | 702 | −2868 | −1967 | −1046 | 3068 | −647 | −1207 | −1344 | 70 | −2470 | −3066 | −2396 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −101 | -8883 | −3935 | -894 | −1115 | −1271 | −772 | * | * | | | | | | | | | | | | |
| 12 | −1559 | −1387 | −3825 | −186 | −1341 | −3115 | −1989 | 1464 | −2819 | 1243 | −570 | −2733 | 917 | −2459 | −2652 | −2199 | −1500 | 1701 | −1870 | 1761 | 12 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −5 | -8787 | -9829 | -894 | −1115 | −1745 | −511 | * | * | | | | | | | | | | | | |
| 13 | −20 | −2755 | 1051 | −585 | −3075 | −2260 | −918 | −2825 | 752 | −2771 | −1845 | 77 | −14 | 1189 | 708 | 174 | 1753 | −231 | −2939 | −2257 | 13 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1827 | -8787 | −482 | -894 | −1115 | −1745 | −511 | * | * | | | | | | | | | | | | |
| 14 | 1722 | −1083 | −1072 | −545 | −1235 | −1655 | −474 | −696 | 1199 | 806 | −318 | −668 | −1802 | −226 | −368 | −713 | −528 | −545 | −1539 | −1099 | 14 |
| — | −149 | −500 | 233 | 43 | −381 | 398 | 105 | −626 | 210 | −466 | −721 | 275 | 394 | 45 | 98 | 359 | 117 | −369 | −295 | −246 | |
| . | −716 | −1368 | -8020 | −124 | −3604 | −2304 | −327 | * | * | | | | | | | | | | | | |
| 15 | 489 | −1508 | -819 | −264 | −1706 | −1689 | 2122 | −1333 | −61 | −1497 | −709 | −497 | −1798 | −60 | 1894 | 512 | −577 | 786 | −1857 | −1327 | 16 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −12 | −7489 | -8531 | -894 | −1115 | −308 | −2379 | * | * | | | | | | | | | | | | |
| 16 | 163 | −1531 | −2635 | −25 | −1518 | −974 | −1598 | 1498 | −1850 | 1034 | −723 | −2020 | −574 | −1664 | 76 | 53 | 253 | 992 | −1959 | −1572 | 17 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | -8803 | -9845 | -894 | −1115 | −1678 | −540 | * | * | | | | | | | | | | | | |
| 17 | −1305 | −2658 | −1201 | 1440 | −2932 | −2298 | 2301 | −2649 | 1515 | −1048 | 1693 | −953 | 86 | −518 | −213 | −412 | −235 | 330 | −2871 | −2218 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | -8803 | -9845 | -894 | −1115 | -840 | −1180 | * | * | | | | | | | | | | | | |
| 18 | −3467 | −4065 | −4298 | −2935 | 1472 | −4065 | −2011 | −4171 | 1010 | −3923 | −3267 | −2803 | −4024 | −1614 | 3622 | −3399 | −68 | −3963 | −3792 | −3601 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | -8883 | -9925 | -894 | −1115 | −1271 | −772 | * | * | | | | | | | | | | | | |
| 19 | −1353 | −2797 | 1112 | 718 | 1088 | −2331 | −991 | −2849 | 816 | −350 | −1890 | 1404 | −2424 | −535 | −106 | 946 | −389 | −393 | −2988 | −2312 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −95 | -8883 | −4022 | -894 | −1115 | −1271 | −772 | * | * | | | | | | | | | | | | |
| 20 | −479 | −2743 | 967 | 759 | −3053 | 282 | −932 | −655 | 569 | −712 | −1835 | −910 | 877 | −475 | −1023 | 1672 | −1234 | −2359 | −2933 | −2256 | 21 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | -881 | -8793 | −1137 | -894 | −1115 | −1721 | −522 | * | * | | | | | | | | | | | | |
| 21 | 422 | −2134 | 295 | 1006 | 798 | −1761 | −430 | −2126 | −34 | −2130 | −1236 | −415 | −1857 | 1080 | −534 | 1559 | −716 | −1730 | −2345 | 766 | 22 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −336 | −7921 | −2296 | -894 | −1115 | −3250 | −160 | * | * | | | | | | | | | | | | |
| 22 | −924 | −2060 | 648 | 2026 | −2266 | −1765 | −598 | 1732 | −339 | −2017 | −1222 | −459 | −1957 | −215 | -847 | -858 | 1037 | −1512 | −2365 | −1739 | 23 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −11 | −7596 | -8638 | -894 | −1115 | −2955 | −199 | * | * | | | | | | | | | | | | |
| 23 | 547 | −1837 | −652 | 562 | −2050 | −1692 | −360 | −1724 | 659 | 417 | −957 | 1199 | −1781 | 52 | 1056 | −614 | −607 | 538 | −2087 | −1484 | 24 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −10 | −7694 | -8736 | -894 | −1115 | −230 | −2760 | * | * | | | | | | | | | | | | |
| 24 | −425 | −2517 | 1415 | 1412 | 683 | −1082 | −1066 | −105 | −709 | −2482 | −1638 | 1216 | −2481 | −657 | −1189 | −354 | 637 | −283 | 1671 | −2171 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −5 | -8868 | -9910 | -894 | −1115 | -403 | −2036 | * | * | | | | | | | | | | | | |
| 25 | −150 | −2913 | −227 | 1323 | −3233 | 2027 | −1067 | −2985 | 785 | −2929 | −2004 | 93 | −126 | −608 | −1163 | 437 | −352 | −2535 | −3097 | −2412 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | −1408 | −2881 | 138 | 354 | −3202 | −2380 | 1744 | −2953 | 2081 | −2897 | −1970 | 1162 | −9 | −579 | 439 | 608 | 540 | −2503 | −3064 | −2381 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −540 | -8959 | −1690 | -894 | −1115 | −701 | −1378 | * | * | | | | | | | | | | | | |
| 27 | −1060 | −2360 | 633 | 640 | −2613 | −2063 | −729 | −2317 | 653 | 400 | −1467 | −728 | −2154 | −295 | 633 | −219 | 1182 | −45 | 2864 | −1946 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −6 | -8426 | -9468 | -894 | −1115 | −1770 | -501 | * | * | | | | | | | | | | | | |
| 28 | −1125 | 1842 | 508 | 1629 | −2828 | −194 | −770 | −98 | 288 | −2539 | −1630 | −755 | 682 | −319 | 20 | −116 | 373 | −27 | −2733 | −2067 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −6 | -8539 | −9581 | -894 | −1115 | −428 | −1962 | * | * | | | | | | | | | | | | |
| 29 | −1810 | −1968 | −2810 | −2250 | 2058 | −439 | −1675 | −1541 | 57 | −1813 | −1163 | −2227 | −3175 | 537 | −2208 | −2133 | 240 | −1430 | 4106 | 2634 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | -8883 | −9925 | -894 | −1115 | −1271 | −772 | * | * | | | | | | | | | | | | |
| 30 | −1351 | −2821 | 1219 | 1223 | −3141 | −2325 | −984 | −344 | 1231 | −2837 | −1911 | 611 | 35 | −524 | 366 | 871 | −129 | −206 | −3005 | −2323 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −176 | -8883 | −3149 | -894 | −1115 | −1271 | −772 | * | * | | | | | | | | | | | | |
| 31 | −1425 | −1258 | −3714 | −127 | 1232 | −2967 | −1826 | 1797 | −2690 | 924 | 1589 | −2593 | −3015 | 521 | −2509 | −2049 | −1365 | −669 | 2320 | 1805 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | -8712 | −9754 | -894 | −1115 | −1177 | -842 | * | * | | | | | | | | | | | | |
| 32 | −114 | −2720 | 1674 | 517 | 249 | −2279 | −941 | −2755 | 1521 | −2727 | −1815 | −923 | −2372 | −488 | −1034 | 1110 | 258 | 176 | −2916 | −2247 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | -8797 | -9840 | -894 | −1115 | −308 | −2379 | * | * | | | | | | | | | | | | |
| 33 | 415 | −2821 | -87 | -82 | −3118 | −376 | −1052 | −901 | 403 | −4 | 2622 | 1070 | 565 | −600 | 1025 | −1299 | −1347 | −2430 | −3019 | −2352 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 34 | −1744 | −3215 | 1670 | −914 | −3565 | −230 | −1347 | −3321 | 322 | −3261 | −2356 | −1231 | −76 | −903 | 264 | 2561 | −1699 | −2866 | −3427 | −2733 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 35 | 1329 | −2850 | 765 | −740 | −3159 | −2400 | −1066 | −674 | 396 | −2864 | −1951 | −1046 | 840 | −613 | 291 | 1940 | −1365 | −2467 | −3049 | −2379 | 36 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 36 | −143 | −2702 | 206 | -835 | 41 | 2448 | −1134 | −2633 | 633 | −73 | −1820 | 450 | −697 | −709 | −1252 | −1380 | −1395 | −2280 | −2943 | −2315 | 37 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −213 | -8959 | −2887 | -894 | −1115 | −701 | −1378 | * | * | | | | | | | | | | | | |
| 37 | 166 | −2414 | −4715 | −5003 | −5062 | 3399 | −4318 | −4870 | −4890 | −5128 | −4171 | −3432 | 458 | −4369 | −4612 | −2052 | 396 | −3596 | −5281 | −5222 | 38 |
| — | −149 | −500 | 233 | 43 | −381 | 398 | 105 | −626 | 210 | −466 | −721 | 275 | 394 | 45 | 96 | 359 | 121 | −369 | −295 | −249 | |
| H | −102 | −3892 | −9793 | −983 | −1017 | −268 | −2560 | * | * | | | | | | | | | | | | |
| 38 | −1596 | −1579 | −3159 | −223 | −1532 | −3039 | −1860 | 310 | −2305 | 2337 | 1275 | 1260 | −3096 | −285 | −2369 | −2086 | −1536 | −995 | −2014 | 263 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 39 | 936 | −1541 | −3987 | −3379 | −1508 | 36 | −2149 | −947 | −2993 | 1002 | −761 | −2877 | −3290 | −2630 | −2819 | −2309 | −1647 | 2237 | −2031 | 2169 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 40 | −427 | −1983 | −2019 | −1459 | −2030 | −2699 | 462 | −1613 | −1325 | −479 | −1154 | −1625 | 5 | 1216 | −1689 | 1747 | 1510 | 605 | −2361 | 657 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 41 | 1676 | −1543 | −3171 | −2578 | 383 | 346 | −1844 | −1063 | −2315 | 846 | 914 | −2394 | −3073 | −2070 | 49 | −262 | 1418 | −969 | −1988 | −1623 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 42 | −1894 | −1793 | −3798 | −3120 | −1634 | −3368 | −2136 | 213 | 2065 | 2102 | 1311 | −2819 | −3393 | −2385 | −578 | −2451 | −1824 | −1166 | −2197 | 634 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 43 | −1479 | −2958 | 1166 | 898 | −3276 | −2422 | −1102 | −3029 | 1390 | 573 | −2050 | 1786 | −2531 | 1081 | −1207 | 272 | −1420 | −2579 | −3141 | −2453 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 44 | 704 | −2518 | −1559 | −1017 | −2771 | 2206 | −1254 | −2430 | −922 | −2549 | −1723 | 415 | 914 | 659 | −1390 | −78 | −1432 | −313 | 1780 | −2290 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 45 | 409 | −2221 | −4870 | −4267 | 1808 | −4170 | −3081 | 1837 | −3906 | 1595 | 868 | −3820 | −4107 | −3458 | −3700 | −3289 | −2421 | 1369 | −2773 | −2504 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 46 | −148 | −2747 | −1318 | 291 | 163 | −2410 | −1075 | −2725 | 1452 | 422 | −1851 | 1380 | −503 | −635 | −93 | 1005 | −1352 | −219 | −2964 | −2317 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 47 | 940 | −2876 | −1251 | 1392 | −3197 | −371 | −1036 | −693 | 1334 | −2892 | −1965 | 851 | 195 | 818 | 269 | −496 | −181 | −2498 | −3059 | −2377 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −334 | -8959 | −2289 | -894 | −1115 | −701 | −1378 | * | * | | | | | | | | | | | | |
| 48 | 1297 | −2733 | 1535 | 1431 | −3056 | −2202 | -892 | −2807 | −489 | −2754 | −1834 | -841 | −2316 | −437 | 588 | 1066 | 285 | −2358 | −2926 | −2239 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −1424 | -8630 | −679 | -894 | −1115 | −1369 | −706 | * | * | | | | | | | | | | | | |
| 49 | 803 | −1427 | -825 | −268 | −1590 | −1685 | −402 | −1196 | -84 | −1388 | −612 | −497 | −1785 | 1471 | 1155 | −643 | 965 | 1173 | −1775 | −1255 | 52 |
| — | −148 | −500 | 233 | 43 | −381 | 398 | 105 | −626 | 210 | −465 | −721 | 275 | 394 | 45 | 98 | 359 | 117 | −369 | −295 | −250 | |
| . | −2627 | −1417 | −1109 | −95 | −3978 | −3529 | −131 | * | * | | | | | | | | | | | | |
| 50 | −647 | −1874 | 345 | 2351 | −2421 | −1193 | −364 | −2177 | −170 | −2216 | −1421 | 5 | −1573 | 3 | −682 | 1515 | −704 | −1731 | −2422 | −1729 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −23 | −6571 | −7613 | -894 | −1115 | −3813 | −106 | * | * | | | | | | | | | | | | |
| 51 | -899 | −2032 | −304 | −38 | −2497 | −1533 | −197 | −2187 | 2614 | −2098 | −1325 | 1798 | −1736 | 202 | 407 | −783 | -831 | −1823 | −2144 | −1654 | 55 |
| — | −149 | −500 | 233 | 43 | −381 | 398 | 105 | −624 | 210 | −466 | −721 | 275 | 394 | 48 | 96 | 359 | 118 | −369 | −295 | −250 | |
| . | −1736 | −526 | −7613 | −95 | −3978 | −3813 | −106 | * | * | | | | | | | | | | | | |
| 52 | −1058 | −756 | −3314 | −2780 | 2123 | −2856 | −1783 | 2040 | −2494 | 322 | 455 | −2437 | −2766 | −2117 | −2391 | −2006 | −1010 | 1931 | −1454 | −1041 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −23 | −6571 | −7613 | -894 | −1115 | −212 | −2869 | * | * | | | | | | | | | | | | |
| 53 | −137 | −2628 | 198 | 380 | 1296 | −391 | −995 | −129 | 216 | −2615 | 539 | −993 | −330 | −560 | 339 | −1242 | 2081 | −2214 | −2853 | −2213 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8832 | −9874 | -894 | −1115 | −347 | −2225 | * | * | | | | | | | | | | | | |
| 54 | −1404 | −2867 | 133 | 1837 | −3184 | 317 | 797 | −2932 | −621 | -832 | −1958 | −1016 | −788 | 743 | 268 | 7 | 794 | −336 | −3053 | 518 | 59 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 55 | −588 | −1651 | −2743 | −2164 | 1976 | 1343 | 1017 | −1193 | −1959 | −1516 | -843 | −2131 | 684 | −1775 | −306 | −217 | 137 | 1029 | 1859 | −1691 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −2704 | -8959 | −244 | -894 | −1115 | −701 | −1378 | * | * | | | | | | | | | | | | |
| 56 | −656 | −1699 | −141 | 133 | −1449 | −1369 | 2746 | −1700 | 586 | −1661 | −931 | −99 | −1557 | 2522 | 337 | −569 | −593 | −1400 | −1541 | -847 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −28 | −6283 | −7325 | -894 | −1115 | −3178 | −169 | * | * | | | | | | | | | | | | |
| 57 | −514 | −655 | −2362 | −2023 | −1208 | −1770 | −1602 | 643 | −1768 | −621 | −255 | −1663 | −2162 | −1628 | −1860 | −1023 | 1901 | 2468 | −1941 | −1553 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −22 | −6610 | −7652 | -894 | −1115 | −163 | −3225 | * | * | | | | | | | | | | | | |
| 58 | −108 | −1696 | −2389 | −1818 | −1701 | −2777 | −1546 | 616 | −245 | 534 | -881 | −1873 | −2846 | 1589 | 237 | −470 | 1240 | 1453 | −2108 | −1699 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5 | -8875 | −9917 | -894 | −1115 | −1319 | −739 | * | * | | | | | | | | | | | | |
| 59 | −5504 | −4447 | −5929 | −6269 | 977 | −5803 | −2007 | −4344 | −5825 | −528 | −3746 | −4425 | −5655 | −4556 | −5194 | −5049 | −5355 | −4523 | 5717 | 2387 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5 | -8875 | −9917 | -894 | −1115 | −1319 | −739 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 60 | −1665 | −1478 | −4011 | −3385 | 1369 | −340 | −2101 | 1537 | −2988 | −1266 | 1273 | −2876 | −3276 | −2612 | −2794 | −2324 | −1607 | 2489 | −1949 | 1619 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5 | -8875 | −9917 | -894 | −1115 | −416 | −1996 | * | * | | | | | | | | | | | | |
| 61 | −31 | −2658 | −4005 | −3959 | −4975 | 3327 | −3824 | −4751 | −20 | −4942 | −4022 | −3241 | −3611 | −3658 | −3959 | 36 | 176 | −3675 | −5120 | −4879 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 62 | −1850 | 1106 | −4529 | −4187 | −2755 | −2972 | −3115 | −2302 | −3816 | −2682 | −2007 | −3266 | −3500 | −3449 | −3647 | 1139 | 1669 | 41 | 5178 | −2895 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 63 | 347 | 1353 | −2513 | −1941 | −1731 | −2855 | −1632 | −1292 | 27 | 894 | 843 | −1978 | 1984 | 473 | −2006 | 420 | 131 | −151 | −2148 | −1744 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 64 | −2265 | −3509 | −2207 | −1558 | −3965 | 2804 | −1544 | −3590 | 631 | −3456 | 1194 | 600 | −3179 | 1479 | 533 | −2148 | −2147 | −3215 | −3516 | −3042 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 65 | −495 | −1628 | -80 | 326 | −1612 | −2946 | −1748 | 1122 | −160 | 549 | 548 | −2195 | −3009 | −1845 | −2198 | −1973 | 644 | 2070 | −2062 | −1680 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 66 | −1405 | −2860 | 394 | 1094 | −3173 | −2382 | 1690 | −279 | −625 | −2872 | −1951 | 883 | 1517 | 377 | −1131 | 800 | 31 | −254 | −3048 | −147 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 67 | −1441 | −2425 | 119 | 263 | −2580 | −488 | −1193 | 825 | -879 | −2368 | 1042 | −1244 | 865 | 661 | −1340 | −187 | 1012 | 1529 | −2718 | −2154 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 68 | −141 | −2886 | 2310 | −67 | −3206 | −474 | −1045 | −2956 | 1001 | −1279 | −1975 | 369 | 1378 | 301 | −1135 | −1293 | 115 | −2507 | −3069 | −2386 | 73 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 69 | −79 | −2877 | 713 | 1949 | −3197 | −406 | −1038 | −2947 | 407 | −2892 | −1966 | −1014 | −501 | 744 | −1126 | 792 | 277 | 157 | −3060 | −2378 | 74 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 70 | −172 | −2862 | 1694 | 1160 | −3177 | −2381 | −1040 | −687 | 755 | −284 | −1953 | −44 | −2474 | −582 | 368 | 1118 | −1344 | -815 | −3050 | −2371 | 75 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 71 | −1485 | −2964 | 990 | 2286 | −3282 | −2426 | −1109 | −3034 | 757 | −2978 | −2056 | −1059 | 1059 | 1038 | −1215 | −64 | −1427 | 259 | −3147 | −2459 | 76 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1230 | -8959 | -806 | -894 | −1115 | −701 | −1378 | * | * | | | | | | | | | | | | |
| 72 | 710 | −2243 | −497 | 1091 | −2595 | 1068 | −474 | −2334 | 1141 | −2301 | −1402 | −394 | 1603 | −32 | −579 | −721 | −791 | −1898 | −2487 | −1813 | 77 |
| — | −149 | −500 | 233 | 43 | −381 | 399 | 106 | −626 | 210 | −466 | −720 | 275 | 394 | 45 | 96 | 360 | 117 | −369 | −294 | −249 | |
| — | −2903 | −2766 | −475 | −180 | −3090 | −3378 | −146 | * | * | | | | | | | | | | | | |
| 73 | −566 | −932 | −1095 | −1249 | −2242 | 3220 | −1341 | −2244 | −1466 | −2405 | −1835 | −1106 | −1601 | −1346 | −1558 | −760 | -892 | −1687 | −2022 | −2053 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −1082 | −5917 | −969 | −894 | −1115 | −3081 | −181 | * | * | | | | | | | | | | | | |
| 74 | 2538 | −280 | −978 | −943 | −1445 | −589 | -896 | −706 | -883 | −1230 | −712 | −623 | −1201 | −794 | −1024 | 12 | −73 | −359 | −1779 | −1426 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −960 | −5796 | −1096 | -894 | −1115 | −1449 | −658 | * | * | | | | | | | | | | | | |
| 75 | −1398 | −3053 | 2346 | 1994 | −3303 | −1774 | 2019 | −3123 | −746 | −3042 | −2219 | −379 | 1270 | −454 | −1390 | −1169 | −1396 | −2649 | −3225 | −2398 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −12 | −7483 | -8525 | -894 | −1115 | −2565 | −267 | * | * | | | | | | | | | | | | |
| 76 | −746 | −2129 | 1022 | 1546 | 988 | −1681 | −382 | −2130 | −7 | −2124 | −1234 | 936 | −1801 | 56 | −516 | 625 | −689 | −1727 | −2322 | 1457 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −10 | −7710 | -8752 | -894 | −1115 | −2494 | −282 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 77 | 576 | −1038 | −1759 | −1190 | −1043 | −2133 | −907 | 603 | −1014 | 947 | −224 | 967 | 802 | 1206 | −1270 | −1136 | −756 | 558 | −1455 | −1047 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −9 | −7892 | -8934 | -894 | −1115 | −228 | −2773 | * | * | | | | | | | | | | | | |
| 78 | −79 | 897 | −1226 | 770 | −3071 | −2339 | 1193 | −313 | 1763 | −219 | −1868 | −983 | −2431 | 2074 | −208 | −3 | −1295 | −2382 | −2970 | −2301 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5 | -8883 | −9925 | -894 | −1115 | −1271 | −772 | * | * | | | | | | | | | | | | |
| 79 | 670 | −2825 | 1713 | 1005 | −3146 | −2326 | 850 | −2896 | 1069 | −2841 | −1914 | 583 | 27 | 265 | −1073 | −1233 | 561 | −330 | −3008 | −2326 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5 | -8883 | −9925 | -894 | −1115 | −433 | −1948 | * | * | | | | | | | | | | | | |
| 80 | 266 | −2872 | 1096 | 374 | −3190 | −2379 | −1037 | −2939 | 1250 | -869 | 979 | 155 | −133 | −578 | 1263 | −34 | 519 | −1130 | −3056 | −2375 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 81 | −1956 | −1755 | −173 | −3624 | −1809 | −3579 | −2507 | 1715 | −3274 | 683 | −989 | −3190 | −3612 | −2939 | −3139 | −325 | 86 | 2605 | −2394 | −2040 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 82 | −226 | −2856 | −1262 | −118 | −3168 | −406 | −1043 | 275 | 1133 | −2868 | −1948 | −124 | 74 | −586 | −158 | 1726 | 1307 | −2473 | −3045 | −2368 | 88 |
| — | −149 | −500 | 236 | 42 | −381 | 398 | 105 | −627 | 210 | −465 | −721 | 275 | 393 | 47 | 97 | 360 | 117 | −370 | −295 | −250 | |
| E | −3078 | −4100 | −281 | −2409 | −301 | −701 | −1378 | * | * | | | | | | | | | | | | |
| 83 | −1266 | −978 | −3328 | −2849 | −488 | −3033 | −2133 | 1056 | −2539 | 1875 | 586 | −2627 | −2925 | −2209 | −2494 | −2241 | −1237 | 2245 | −1750 | −1471 | 95 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −24 | −6467 | −7509 | -894 | −1115 | −151 | −3335 | * | * | | | | | | | | | | | | |
| 84 | −1367 | −2841 | 449 | 678 | −3162 | -879 | 1667 | −2913 | 1173 | −2857 | −1931 | 0 | 1463 | 2326 | 331 | −1247 | −1307 | −2463 | −3024 | −2341 | 96 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | -8883 | −9925 | -894 | −1115 | −1271 | −772 | * | * | | | | | | | | | | | | |
| 85 | 22 | −2813 | 955 | 980 | −369 | −301 | −986 | −263 | 624 | -885 | −1903 | 10 | −2420 | −528 | 1331 | 489 | 173 | −2432 | −2999 | −2319 | 97 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | -8883 | −9925 | -894 | −1115 | −1271 | −772 | * | * | | | | | | | | | | | | |
| 86 | -83 | −1385 | −5 | −3126 | 588 | −3073 | −1936 | 392 | −2750 | 2240 | −578 | −2675 | −3123 | 275 | −2596 | −2152 | −1479 | 351 | −1839 | 708 | 98 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | -8883 | −9925 | -894 | −1115 | −433 | −1948 | * | * | | | | | | | | | | | | |
| 87 | −560 | −2860 | 297 | 1249 | −643 | −354 | −1041 | −396 | 1428 | 168 | −1951 | −1020 | −18 | 1573 | −1130 | −53 | −1344 | −2478 | −3048 | −2369 | 99 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 88 | −1444 | −2919 | 1300 | 2135 | −3238 | 328 | −1072 | −2989 | −660 | −2934 | −2010 | 467 | 82 | 861 | −1170 | −578 | 475 | −343 | −3102 | −2417 | 100 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 89 | −1428 | −2898 | −77 | 1613 | −3221 | −2396 | −1054 | −2970 | 1998 | −2913 | 214 | 1409 | −2491 | −595 | 1059 | −1307 | 831 | −2521 | −3079 | −2399 | 101 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 90 | −1592 | 1571 | −3825 | −3197 | 2895 | −1068 | 1004 | 927 | −2816 | 411 | −637 | 151 | −3177 | −2460 | −645 | −2206 | −1532 | -850 | −1880 | 1714 | 102 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −101 | -8959 | −3933 | -894 | −1115 | −701 | −1378 | * | * | | | | | | | | | | | | |
| 91 | −1513 | −3004 | 49 | 354 | −3319 | −2410 | −1124 | −3075 | 98 | −3017 | −2100 | 2265 | −2542 | 420 | −1258 | 1536 | 1743 | −2623 | −3186 | −2489 | 103 |
| — | −150 | −501 | 232 | 45 | −382 | 399 | 105 | −627 | 209 | −467 | −721 | 276 | 393 | 47 | 97 | 361 | 118 | −370 | −284 | −250 | |
| E | −191 | −4004 | −4014 | −3112 | −177 | −394 | −2065 | * | * | | | | | | | | | | | | |
| 92 | 252 | 3625 | −3856 | −3221 | 59 | −3072 | −1940 | -847 | −2820 | −143 | −558 | −2712 | −3122 | −2445 | −2625 | 749 | −1467 | 1457 | 1840 | 1618 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5 | -8874 | −9917 | -894 | −1115 | −1322 | −737 | * | * | | | | | | | | | | | | |
| 93 | 524 | −1367 | −3725 | −3098 | 244 | −3051 | 2088 | 470 | −2724 | −202 | −569 | −2651 | −3103 | −2373 | 87 | −140 | 148 | 2005 | −1823 | 1042 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5 | -8874 | −9917 | -894 | −1115 | −415 | −1999 | * | * | | | | | | | | | | | | |

-continued

| | | | | | | | | | | | | | | | | | | | | |
|---|---|---|---|---|---|---|---|---|---|---|---|---|---|---|---|---|---|---|---|---|
| 94 | 304 | −1571 | −3113 | −2525 | 570 | −2995 | −1841 | −1101 | −2271 | −344 | −778 | −2364 | 3038 | −2038 | 66 | −350 | 146 | 133 | −2022 | −1654 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 95 | 290 | −2234 | −5012 | −4487 | 321 | −4388 | −3521 | 998 | −4188 | −1907 | −1536 | −4058 | −4373 | −3892 | −4079 | −3548 | 1259 | 3029 | −3321 | −2942 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 96 | −1582 | −1459 | −283 | −3004 | 2433 | −3093 | −1945 | 413 | −2664 | −7 | −660 | 40 | 9 | −2344 | −27 | −2164 | −1522 | 18 | 3152 | 1924 | 118 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 97 | −1748 | −1575 | −4028 | −3399 | −1456 | −3300 | −2168 | 454 | −3011 | 2396 | 1325 | −2925 | −129 | 349 | −2832 | −2385 | 486 | 339 | −2026 | −1696 | 119 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 98 | −1972 | −3002 | 2302 | −1573 | −3794 | −2773 | −2038 | −3504 | −1825 | −735 | −2752 | −1798 | 1531 | −1667 | −2322 | 1819 | 1388 | −3030 | −3858 | −3248 | 120 |
| — | −149 | −500 | 232 | 44 | −381 | 400 | 105 | −627 | 211 | −467 | −721 | 275 | 395 | 45 | 95 | 360 | 117 | −370 | −295 | −250 | |
| H | −274 | −4100 | −3127 | −2409 | −301 | −701 | −1378 | * | * | | | | | | | | | | | | |
| 99 | −15 | −2789 | 2461 | 1466 | −3108 | −2275 | −943 | −2860 | −529 | −2804 | −1879 | −910 | −399 | 919 | 487 | −266 | 207 | −2410 | −2972 | −2287 | 127 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −5 | -8785 | −9827 | -894 | −1115 | −296 | −2430 | * | * | | | | | | | | | | | | |
| 100 | −564 | −2880 | 1170 | 1980 | −3198 | −2386 | −1047 | 403 | −67 | −2895 | −1971 | −1023 | −2481 | 645 | 298 | −1296 | 1743 | −2500 | −3065 | −2384 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 101 | −1452 | −2408 | 1662 | −1008 | −2556 | −2523 | −1208 | 1018 | 935 | 702 | −1546 | −1268 | −2610 | 665 | 316 | −1455 | 834 | −149 | −2705 | −2149 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 102 | 1006 | −1433 | −3778 | −3152 | 1817 | −3114 | 383 | 1009 | −2780 | 183 | −635 | 152 | −3166 | −376 | −2633 | −279 | −1524 | 1374 | −1888 | 855 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 103 | −173 | −2884 | 1895 | 1507 | −3205 | −2382 | 585 | −2956 | 1400 | −2900 | −1973 | 959 | −2476 | 730 | −1132 | −1291 | −260 | −458 | −3067 | −2384 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 104 | 355 | −2873 | −1253 | 1252 | −3192 | 172 | −1037 | −2942 | 910 | −21 | 229 | 472 | −2472 | 1462 | 221 | 638 | −1343 | −2494 | −3057 | −2376 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 105 | 177 | −1647 | −3439 | −2848 | 1416 | −3171 | 2965 | −1163 | −2540 | −264 | -847 | −2584 | −3224 | −2274 | 43 | −2229 | 118 | −1075 | −1887 | 3185 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 106 | −4478 | −4379 | −5338 | −4170 | −1407 | −4948 | −2103 | −4381 | 245 | −3905 | −3642 | −3640 | −4850 | −2669 | 398 | −4304 | −4185 | −4365 | 2169 | 4534 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 107 | −1425 | −2897 | 237 | 288 | −3217 | −2392 | 2636 | −2968 | 672 | −743 | −1987 | 2503 | −2488 | −595 | 299 | 637 | −1364 | −2519 | −3079 | −2397 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 108 | −2244 | −3335 | −1526 | −1406 | −3583 | 2726 | 1138 | 884 | −1497 | −3395 | −2615 | 1510 | −3209 | 1384 | −1895 | −2169 | −2227 | −2995 | −3635 | −3021 | 136 |
| — | −149 | −500 | 233 | 43 | −381 | 398 | 105 | −627 | 210 | −466 | −721 | 275 | 393 | 48 | 98 | 360 | 117 | −370 | −295 | −250 | |
| H | −4123 | −4100 | −177 | −1491 | −634 | −701 | −1378 | * | * | | | | | | | | | | | | |
| 109 | −1566 | −1294 | −2100 | −2001 | 454 | −1834 | −511 | −1219 | −1508 | −1002 | -839 | −1682 | −2130 | −1491 | −1439 | −1793 | −1620 | −1256 | 5487 | 814 | 140 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −37 | −5860 | −6902 | -894 | −1115 | −3019 | −190 | * | * | | | | | | | | | | | | |
| 110 | −705 | −948 | −1618 | −1303 | −690 | −1755 | −1020 | −158 | −1010 | 1700 | 117 | −1247 | 2211 | −977 | −1162 | −1032 | −778 | −243 | −1421 | −996 | 141 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −25 | −6433 | −7475 | -894 | −1115 | −3841 | −104 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 111 | 1700 | −557 | −1695 | −1297 | −763 | −1420 | −946 | 50 | −1030 | −224 | 3161 | −1099 | −1771 | −916 | −1178 | −626 | −401 | 101 | −1403 | −1029 | 142 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −25 | −6433 | −7475 | -894 | −1115 | −64 | −4518 | * | * | | | | | | | | | | | | |
| 112 | −4565 | −3931 | −5739 | −5782 | 3490 | −5425 | −2129 | 141 | −5358 | −3182 | −3080 | −4332 | −5341 | −4368 | −4882 | −4625 | −10 | −3547 | −1410 | 3544 | 143 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 113 | 1855 | 4070 | −5342 | −5662 | −5270 | −2885 | −4634 | −5071 | −5293 | −5349 | −4389 | −3719 | −3700 | −4736 | −4907 | 2450 | −2470 | −3788 | −5501 | −5472 | 144 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 114 | −3213 | −5100 | 550 | 1018 | −5286 | −3172 | −2476 | −5191 | 2362 | −5049 | −4362 | 3226 | −3686 | −2136 | −3391 | −2878 | −3266 | −4672 | −5228 | −4245 | 145 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 115 | 449 | −2880 | −1253 | 325 | −3201 | −2380 | 1383 | −2951 | 403 | −2896 | −1969 | 1663 | 74 | 1692 | 212 | 1362 | −1346 | −2502 | −3063 | −2380 | 146 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 116 | −125 | −1430 | −3848 | −3218 | −1386 | −3129 | 574 | 2301 | −2832 | −128 | −632 | −2746 | −3180 | 435 | −2664 | −2210 | 109 | 2053 | −1888 | 297 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 117 | −4650 | −4007 | −7007 | −6424 | 624 | −6837 | −5317 | 1113 | −6231 | 3041 | −796 | −6543 | −5770 | −4901 | −5662 | −6240 | −4476 | −2302 | −3808 | −3932 | 148 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 118 | −6136 | −5373 | −6282 | −6179 | −4244 | −5466 | −4668 | −6785 | −4688 | −6196 | −6062 | −5854 | −5831 | −5324 | 236 | −6305 | −6186 | −6637 | 6199 | −3805 | 149 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 119 | −3855 | −4453 | 285 | −3128 | 657 | −4033 | −3606 | −5516 | −4486 | −5291 | −4958 | −3318 | 4059 | −3848 | −4972 | −3836 | −4131 | −5058 | −4074 | −3128 | 150 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 120 | −421 | −2267 | −5032 | −4491 | −2376 | −4412 | −3487 | 1533 | −4182 | 2108 | −1395 | −4068 | −4370 | −3847 | −4051 | −3564 | 1563 | 1193 | −3244 | −2898 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 121 | −2056 | 1461 | −4340 | −3736 | 3377 | −3593 | −2257 | 315 | −3338 | 1231 | -838 | −3194 | −3607 | 463 | −3123 | −2686 | −1992 | −1214 | −1971 | 829 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 122 | −6595 | −5567 | −6099 | −6438 | −5559 | −5537 | 5463 | −7721 | −6484 | −7100 | −7039 | −6386 | −5985 | −6472 | −6145 | −6901 | −6790 | −7414 | −5292 | −5215 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −263 | -8959 | −2605 | -894 | −1115 | −701 | −1378 | * | * | | | | | | | | | | | | |
| 123 | −5907 | −4878 | −5926 | −6279 | −1901 | −5375 | −3243 | −5538 | −6146 | −4875 | −4948 | −5278 | −5644 | −5409 | −5629 | −5808 | −5948 | −5605 | −2536 | 4916 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | -8702 | −9744 | -894 | −1115 | −2048 | −399 | * | * | | | | | | | | | | | | |
| 124 | −1596 | −2240 | −1987 | −1365 | −2353 | −2702 | 2791 | 709 | 493 | −179 | 2664 | −1536 | −2766 | 1756 | 1222 | −1691 | −1515 | −1749 | −2532 | −2081 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −5 | -8702 | −9744 | -894 | −1115 | −2048 | −399 | * | * | | | | | | | | | | | | |
| 125 | −1457 | −1290 | −3734 | −3108 | −1165 | −52 | −1830 | 1809 | −2714 | 1473 | −474 | −2615 | 1632 | −2344 | −2534 | −2079 | −1398 | −697 | 2219 | 982 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −5 | -8702 | −9744 | -894 | −1115 | −2048 | −399 | * | * | | | | | | | | | | | | |
| 126 | −1611 | −2691 | 383 | −934 | −2885 | 1234 | −1328 | −2585 | −1072 | −363 | −1893 | 1472 | 2599 | −957 | −1566 | −1564 | −1579 | −2280 | 2067 | −2389 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −1806 | -8702 | −491 | -894 | −1115 | −2048 | −399 | * | * | | | | | | | | | | | | |
| 127 | −493 | −1319 | −931 | −456 | −2029 | −1424 | −515 | −1655 | 27 | −1780 | −995 | −567 | 2227 | −163 | 1245 | −556 | 1707 | −1283 | −2059 | −1589 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −405 | −6914 | −2080 | -894 | −1115 | −3730 | −113 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 128 | −684 | −1624 | −265 | −119 | −2139 | −1361 | −439 | −1943 | 40 | −1961 | −1238 | −332 | 2202 | 2697 | −257 | −660 | −735 | −1573 | −2121 | −1588 | 159 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −23 | −6532 | −7574 | -894 | −1115 | −2206 | −352 | * | * | | | | | | | | | | | | |
| 129 | −712 | -857 | −1732 | 1116 | −584 | −2047 | −770 | −273 | −967 | 498 | 3024 | −1192 | −2102 | -817 | −1171 | −1074 | −650 | −235 | −1122 | 1954 | 160 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −14 | −7316 | -8358 | -894 | −1115 | −1129 | -882 | * | * | | | | | | | | | | | | |
| 130 | −1059 | 1177 | 2715 | −1059 | 186 | −2245 | −1021 | −1218 | −940 | −1479 | −760 | −1211 | −2351 | -832 | −1301 | 345 | 883 | −1050 | −1912 | 1055 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −7 | -8256 | −9298 | -894 | −1115 | −1466 | −648 | * | * | | | | | | | | | | | | |
| 131 | −1137 | −2290 | −1127 | −578 | 519 | −2162 | -837 | −2176 | −467 | −2261 | −1417 | 1644 | 2036 | 642 | 1335 | 222 | −1077 | 34 | −2549 | −1947 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −6 | -8499 | −9541 | -894 | −1115 | −1634 | −561 | * | * | | | | | | | | | | | | |
| 132 | −235 | −2217 | 982 | −718 | −2383 | −2256 | −943 | 78 | −620 | 350 | −1353 | −986 | 1782 | 975 | −1085 | 821 | 373 | −1754 | −2506 | −1934 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −6 | -8608 | −9650 | -894 | −1115 | −2306 | −326 | * | * | | | | | | | | | | | | |
| 133 | 208 | −2527 | 359 | 527 | −2801 | −2166 | 1508 | 88 | 545 | 6 | −1629 | 1619 | −2258 | 612 | −929 | −1077 | −1112 | −107 | 1991 | −2087 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −6 | -8608 | −9650 | -894 | −1115 | −195 | −2983 | * | * | | | | | | | | | | | | |
| 134 | −560 | −2869 | 989 | 1621 | −3186 | 653 | −1039 | −2934 | 377 | −139 | −1959 | −1017 | −2473 | 743 | −1128 | 752 | −342 | −348 | −3055 | −2374 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 135 | −226 | −2557 | 1239 | −171 | 205 | 798 | −1139 | 228 | 1103 | −2519 | 1535 | −1164 | −56 | −735 | −1265 | −421 | 248 | −338 | −2820 | −2223 | 166 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 136 | 675 | −2854 | −1263 | 1286 | −3164 | −2384 | −1043 | −2907 | 456 | −273 | −1946 | 865 | −2477 | 644 | 1415 | −1291 | 808 | −1120 | −3043 | 533 | 167 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 137 | −2259 | −2270 | −3464 | −2965 | 3224 | −3571 | −1893 | −1843 | −2741 | −2082 | −1485 | 257 | −3630 | 1354 | −2845 | −129 | −2201 | 119 | −1738 | 2632 | 168 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 138 | −1449 | −2891 | 2381 | 1743 | −570 | −470 | 1146 | −2939 | −677 | −1395 | −1986 | −1050 | −2512 | 1358 | −1185 | −1333 | −1389 | −2505 | −3078 | 633 | 169 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 139 | −1428 | −2898 | 1337 | 1285 | −3221 | −2396 | 1189 | −2970 | 402 | −1407 | −1988 | −1032 | −2491 | 817 | 2405 | −48 | −1366 | −2522 | −3079 | −2399 | 170 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 140 | 249 | −2874 | −1252 | 291 | −3194 | −979 | 2199 | −1080 | 332 | −2890 | −1964 | 1424 | −133 | 727 | −190 | 1357 | −455 | −991 | −3058 | −2376 | 171 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 141 | 1264 | −2813 | 236 | 224 | −3095 | −2411 | −1081 | −2820 | −681 | 396 | −1913 | 80 | −2508 | 834 | −1182 | 752 | −1371 | −2414 | 3711 | −2359 | 172 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 142 | −4281 | −3793 | −5329 | −95 | 1043 | −5236 | −2232 | −3122 | −4811 | −2646 | 1146 | −4220 | −5168 | −4138 | −4518 | −4449 | −4197 | −3342 | 5852 | −423 | 173 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 143 | 1103 | −2879 | 2095 | 309 | −3200 | −2381 | −1039 | −2950 | 846 | −1553 | −1969 | −6 | −2474 | 1247 | 791 | −1288 | −1347 | −2501 | −3062 | 523 | 174 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 144 | 1934 | −2789 | 948 | -807 | −281 | 927 | −1128 | −2768 | −744 | −2786 | −1903 | 1627 | −2548 | −693 | 245 | −1375 | −1409 | −2384 | −3012 | 123 | 175 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 145 | −5646 | −4569 | −6016 | −6375 | 1745 | −5886 | −2106 | −4537 | −5938 | −3839 | −3938 | −4526 | −5754 | −4667 | −5302 | −5161 | −5502 | −4698 | −1352 | 4689 | 176 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 146 | −1540 | −1688 | −2645 | −2069 | 331 | −2894 | −1678 | −351 | 505 | 343 | -877 | −529 | −2960 | 1088 | 258 | −1908 | 987 | 2134 | −2110 | −1716 | 177 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 147 | −1410 | −2883 | 197 | 1079 | −3204 | −2382 | 2075 | −2955 | 1787 | −2899 | −1972 | 155 | −2476 | 260 | 1621 | 443 | −244 | −2505 | −3065 | −2383 | 178 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 148 | 1731 | −1543 | −4077 | −3446 | 536 | −3293 | −2170 | 411 | −3047 | −404 | 1320 | −2939 | −3331 | −2664 | −2848 | −2382 | −1669 | 2366 | 1932 | −1682 | 179 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 149 | −2579 | −3282 | −2806 | −3183 | −5254 | −3212 | −3847 | −5461 | −4198 | −5560 | −4756 | 4258 | −3950 | −3720 | −4479 | −120 | −2996 | −4339 | −5388 | −4932 | 180 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 150 | −299 | −3141 | −1636 | 218 | −3514 | −2680 | 1217 | −3221 | 2168 | −3130 | 126 | −1318 | −2756 | 2258 | 1917 | −1621 | −1660 | −2795 | −3251 | −2648 | 181 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 151 | 1188 | −1445 | −3736 | −3113 | 427 | −3113 | −1973 | 1215 | 854 | 1306 | 758 | −2693 | −3165 | −2409 | 651 | −2189 | −1528 | -859 | −1899 | 772 | 182 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 152 | −5558 | −4518 | −6026 | −6352 | 4341 | −5899 | −2122 | −4219 | −5912 | −696 | −3605 | −4534 | −5738 | −4646 | −5283 | −5151 | −5410 | −4485 | −1366 | 1370 | 183 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 153 | 3367 | 823 | −5337 | −5655 | −5281 | 8 | −4633 | −5094 | −5294 | −5360 | −4393 | −3714 | −3696 | −4732 | −4909 | 217 | −2465 | −3795 | −5509 | −5486 | 184 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 154 | −1962 | −3493 | 3125 | 1222 | −3797 | −2690 | 1123 | −3566 | 627 | −1632 | −2605 | −1310 | −2899 | 1105 | −1707 | −1801 | −1919 | −3110 | −3662 | −2939 | 185 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 155 | 1231 | −2902 | −1311 | 273 | −3224 | −2425 | −1073 | −2965 | 2309 | −2913 | −1995 | 459 | −2517 | −617 | 1101 | −1338 | 751 | −927 | −3081 | −2413 | 186 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 156 | 506 | −2757 | −5889 | −5527 | −3311 | −5634 | −5368 | 2953 | −5434 | 258 | −2061 | −5293 | −5414 | −5303 | −5521 | −4956 | −3224 | 2223 | −4851 | −4396 | 187 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −4 | -8959 | −10001 | -894 | −1115 | −701 | −1378 | * | * | | | | | | | | | | | | |
| 157 | 756 | 2465 | −3876 | −1190 | 755 | −417 | −1996 | 433 | −2851 | 93 | 1935 | −524 | −3178 | −2484 | −2671 | −325 | −1526 | 1629 | −1878 | −1534 | 188 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −4 | -8959 | −10001 | -894 | −1115 | −701 | −1378 | * | * | | | | | | | | | | | | |
| 158 | −132 | −2880 | 136 | 1759 | −3201 | −342 | 379 | −2952 | 1060 | −2896 | −1969 | −5 | 718 | −579 | 269 | 1166 | −1346 | −2502 | −3063 | −2380 | 189 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −4 | -8959 | −10001 | -894 | −1115 | −701 | −1378 | * | * | | | | | | | | | | | | |
| 159 | −171 | −2137 | 103 | 1030 | −337 | −2622 | 531 | 919 | −1137 | 59 | −1296 | 1344 | −2704 | −34 | −1545 | −1574 | −1411 | 1536 | −2487 | −1993 | 190 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 160 | 791 | −2000 | −4659 | −4077 | −2028 | −3970 | −2930 | 1919 | −3725 | 166 | −1155 | −3614 | −3966 | −3371 | −3563 | −3090 | −2208 | 1271 | −2734 | 3276 | 191 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 161 | −175 | −2891 | 244 | 1153 | −3212 | −2386 | −1047 | −2963 | 1833 | −2906 | −1980 | 1524 | −2481 | 1370 | 1241 | −396 | −1356 | −2513 | −3073 | −2390 | 192 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1984 | -8959 | −424 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 162 | -859 | -1515 | -1270 | -663 | -1698 | -1828 | -482 | -1305 | 238 | 199 | -749 | -769 | 2362 | -165 | 1927 | -938 | -809 | -1130 | -1814 | -1381 | 193 |
| — | -149 | -500 | 233 | 45 | -381 | 398 | 105 | -626 | 210 | -466 | -721 | 277 | 394 | 45 | 96 | 359 | 117 | -369 | -295 | -250 | |
| . | -416 | -2019 | -8034 | -984 | -1016 | -71 | -4385 | * | * | | | | | | | | | | | | |
| 163 | -2033 | -3584 | 2285 | 1288 | -3882 | -2720 | 1209 | -3658 | 1355 | -3587 | -2700 | -1337 | 1993 | 565 | -1822 | -1864 | -1995 | -3198 | -3754 | -3017 | 196 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 164 | -3537 | -5628 | 2720 | -276 | -5750 | 2733 | -2719 | -5761 | -3176 | -5583 | -5043 | 1023 | -3849 | -2416 | -4226 | -3132 | -3647 | -5184 | -5789 | -4624 | 197 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 165 | 648 | -3645 | 3812 | -2140 | -5495 | -3092 | -3220 | -5408 | -3669 | -5451 | -4702 | -2348 | -3784 | -2969 | -4389 | -61 | -3036 | -4429 | -5616 | -4875 | 198 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 166 | -1741 | -1557 | -4089 | -3456 | 1103 | -3302 | -2174 | 1276 | -3055 | 1231 | 1700 | -2948 | -3337 | -2666 | -2853 | -2390 | 1104 | 1379 | -2015 | 1445 | 199 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 167 | -3355 | -2845 | -6028 | -5701 | 435 | -5853 | -5693 | 3291 | -5655 | -2119 | -2085 | -5506 | -5576 | -5535 | -5782 | -5222 | -3343 | 2335 | -5008 | -4489 | 200 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 168 | -4269 | -3736 | -6574 | -6008 | -1914 | -6218 | -4637 | 330 | -5712 | 272 | 1546 | -5844 | -5498 | -4661 | -5265 | -5498 | -4129 | -2183 | 5803 | -3317 | 201 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 169 | -3297 | 1813 | -5975 | -5641 | -3434 | -5787 | -5696 | 2800 | -5589 | -332 | -2145 | -5442 | -5535 | -5513 | -5729 | -5143 | -3286 | 2726 | -5108 | -4613 | 202 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 170 | -3529 | -4784 | -1711 | -1950 | -4375 | -3550 | 4845 | -5169 | -1992 | -4896 | -4315 | 338 | -3998 | 2297 | -2205 | -3271 | -3540 | -4754 | -4394 | -3588 | 203 |
| — | -149 | -500 | 233 | 43 | -381 | 399 | 106 | -626 | 210 | -466 | -720 | 275 | 394 | 45 | 96 | 359 | 117 | -369 | -294 | -249 | |
| S | -4 | -8959 | -10001 | -894 | -1115 | -701 | -1378 | * | * | | | | | | | | | | | | |
| 171 | -6017 | -5649 | 4213 | -4573 | -6837 | -5145 | -5256 | -7689 | -5916 | -7201 | -7011 | -4892 | -5650 | -5366 | -6133 | -5970 | -6182 | -7241 | -5831 | -6504 | 204 |
| — | -149 | -500 | 233 | 43 | -381 | 399 | 106 | -626 | 210 | -466 | -720 | 275 | 394 | 45 | 96 | 359 | 117 | -369 | -294 | -249 | |
| G | -4 | -8959 | -10001 | -894 | -1115 | -701 | -1378 | * | * | | | | | | | | | | | | |
| 172 | -6277 | -5195 | -6255 | -6614 | -2289 | -5655 | -3618 | -5935 | -6505 | -5261 | -5336 | -5643 | -5936 | -5773 | -5970 | -6193 | -6317 | -5996 | -2912 | 4927 | 205 |
| — | -149 | -500 | 233 | 43 | -381 | 399 | 106 | -626 | 210 | -466 | -720 | 275 | 394 | 45 | 96 | 359 | 117 | -369 | -294 | -249 | |
| G | -4 | -8959 | -10001 | -894 | -1115 | -701 | -1378 | * | * | | | | | | | | | | | | |
| 173 | -1844 | -3168 | -1391 | -1055 | -3266 | -2689 | 4433 | -3188 | -1059 | -3180 | -2325 | 470 | -68 | 639 | -1525 | 614 | -1797 | -2799 | -3282 | 636 | 206 |
| — | -149 | -500 | 233 | 43 | -381 | 399 | 106 | -626 | 210 | -466 | -720 | 275 | 394 | 45 | 96 | 359 | 117 | -369 | -294 | -249 | |
| G | -4 | -8959 | -10001 | -894 | -1115 | -701 | -1378 | * | * | | | | | | | | | | | | |
| 174 | -5647 | -4878 | -6611 | -6689 | -3480 | -5830 | -5714 | -3122 | -6613 | 3375 | -2416 | -6629 | -5924 | -5899 | -6106 | -6640 | -5628 | -3921 | -4748 | -4938 | 207 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 175 | -2027 | -1828 | -4333 | -3719 | 1407 | -3574 | -2301 | 241 | -3321 | 872 | 3993 | -3191 | -3585 | 316 | -3104 | -2667 | -1963 | -1184 | 1996 | 925 | 208 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 176 | -3470 | -3092 | -5848 | -5248 | 736 | -5282 | -4109 | 4 | -4934 | 2743 | -834 | -4948 | 915 | -4202 | -4627 | -4458 | -3376 | 720 | -3364 | -3291 | 209 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |
| 177 | -250 | 1699 | -4666 | -4063 | 412 | -3922 | -2856 | -832 | -3693 | 2366 | -920 | -3588 | -3910 | -3276 | -3494 | -3038 | -2226 | 1863 | -2609 | -2306 | 210 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |
| 178 | 605 | -3179 | -5031 | -5380 | -5649 | -3411 | -4875 | -5592 | -5432 | -5785 | -4939 | -4131 | 4094 | -4996 | -5162 | -2880 | -3097 | -4388 | -5593 | -5741 | 211 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 179 | −226 | −2865 | −1257 | 1435 | 220 | −2381 | 1068 | −2927 | 749 | -814 | −1955 | −1018 | −2474 | 2013 | 304 | −6 | 1028 | −2484 | −3051 | −2372 | 212 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 180 | −1685 | 874 | −4002 | 445 | 2042 | −3233 | −2092 | −951 | −2972 | 1058 | 3385 | −2869 | −3274 | −2590 | −2778 | −2319 | −1625 | −244 | −1943 | 1332 | 213 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 181 | −3778 | −3238 | −6374 | −5959 | −2610 | −6194 | −5586 | 2235 | −5860 | 2520 | −1357 | −5873 | −5644 | −5205 | −5707 | −5567 | −3724 | 1252 | −4413 | −4376 | 214 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 182 | −4103 | −4575 | −5214 | −3428 | −5599 | −4469 | −2275 | −4840 | 1347 | −4415 | −3790 | −3200 | −4388 | −1862 | 3932 | −3979 | −3710 | −4648 | −4172 | −4184 | 215 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 183 | −1445 | −2917 | 406 | 1711 | −3240 | −2407 | −1069 | −2989 | 1794 | −2932 | 1851 | 963 | −2505 | 1826 | −192 | −1324 | −1384 | −2541 | −3097 | −2416 | 216 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 184 | −1479 | −2803 | −1392 | 1321 | −3079 | −2469 | −1115 | −2785 | 1517 | 10 | 870 | −1128 | −2558 | 1098 | 2046 | −1387 | −1415 | −672 | −3007 | −125 | 217 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 185 | −1566 | 770 | -817 | −2662 | 1972 | 337 | −1862 | 1464 | −108 | 1236 | −716 | −461 | −3087 | −2124 | −5 | −2082 | −1507 | −250 | −1963 | −1602 | 218 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 186 | −694 | −2802 | 212 | −95 | −3089 | 453 | 1382 | −1062 | −653 | −915 | −1900 | 1506 | 1871 | −610 | −1155 | 670 | −1349 | −429 | −3005 | −2343 | 219 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 187 | −196 | −2885 | 2190 | 244 | -327 | −2383 | −1044 | −2957 | 589 | −2901 | −1975 | 1624 | −2478 | 301 | 1580 | −554 | −1351 | −2507 | −3068 | −2385 | 220 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −1543 | -8959 | −611 | -894 | −1115 | −701 | −1378 | * | * | | | | | | | | | | | | |
| 188 | −543 | −1862 | −440 | 1184 | −2126 | −1533 | −196 | −1834 | 1595 | −624 | 2062 | 822 | −1627 | 241 | −274 | 276 | −481 | −1453 | −2077 | −1437 | 221 |
| — | −148 | −500 | 233 | 43 | −381 | 400 | 105 | −626 | 211 | −466 | −721 | 275 | 394 | 45 | 96 | 360 | 117 | −369 | −295 | −250 | |
| . | −1645 | −1609 | −1504 | −406 | −2028 | −3545 | −129 | * | * | | | | | | | | | | | | |
| 189 | −1167 | −1629 | −1576 | −962 | −1424 | −2102 | −608 | -896 | 2301 | 1658 | −479 | −1024 | −2178 | −313 | 140 | −1299 | −1071 | −929 | −1767 | −1380 | 224 |
| — | −149 | −500 | 234 | 44 | −381 | 398 | 105 | −627 | 212 | −466 | −721 | 276 | 394 | 45 | 96 | 359 | 117 | −370 | −295 | −250 | |
| . | −1972 | −433 | −7850 | −77 | −4269 | −2856 | −214 | * | * | | | | | | | | | | | | |
| 190 | −623 | −1496 | −646 | −685 | −2989 | 666 | −1226 | −2778 | −1137 | −2866 | −2018 | 3108 | −1915 | −909 | −1576 | 1453 | -884 | −2045 | −3062 | −2502 | 226 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −15 | −7131 | -8173 | −894 | −1115 | −73 | −4340 | * | * | | | | | | | | | | | | |
| 191 | 1777 | −1612 | −3691 | −3089 | −1613 | −3264 | −2135 | 1748 | −3 | 113 | -825 | 941 | −3313 | −2478 | −2713 | −2338 | −1678 | 1470 | −2134 | −1778 | 227 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −101 | -8959 | −3933 | -894 | −1115 | −701 | −1378 | * | * | | | | | | | | | | | | |
| 192 | −1501 | −1969 | −2067 | −1490 | 511 | −2706 | −1414 | 149 | 2707 | −1857 | −1142 | −1640 | 76 | −1209 | 1201 | −1686 | 161 | 70 | −2340 | −1894 | 228 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5 | -8863 | −9905 | -894 | −1115 | −394 | −2065 | * | * | | | | | | | | | | | | |
| 193 | −3607 | −3077 | −6245 | −5874 | −2873 | −6081 | −5714 | 3505 | −5804 | 1156 | −1606 | −5752 | −5638 | −5357 | −5770 | −5460 | −3573 | 662 | −4673 | −4504 | 229 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 194 | −12 | −2598 | −5143 | −5441 | −5217 | 3460 | −4569 | −4977 | −5195 | −5277 | −4333 | −3679 | −3695 | −4653 | −4858 | 47 | −2467 | −115 | −5456 | −5404 | 230 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 195 | −5550 | −4510 | −5995 | −6327 | 4090 | −5863 | 1516 | −589 | −5883 | −3802 | −3874 | −4491 | −5721 | −4625 | −5258 | −5106 | −5404 | −4602 | 2900 | 1385 | 231 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 196 | -5329 | -4446 | -5933 | -6247 | 4361 | -5728 | -2113 | -4364 | -5816 | -3727 | -3796 | -4478 | -5654 | -4615 | -5223 | -4991 | -529 | -4510 | -1366 | 1366 | 232 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 197 | -4197 | -3713 | -6291 | -5791 | -1899 | -5989 | 2805 | 401 | -5286 | 2915 | -905 | -5568 | -5416 | -4535 | -4949 | -5287 | -4076 | -2219 | -3396 | -3073 | 233 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 198 | -6595 | -5567 | -6099 | -6438 | -5559 | -5537 | 5463 | -7721 | -6484 | -7100 | -7039 | -6386 | -5985 | -6472 | -6145 | -6901 | -6790 | -7414 | -5292 | -5215 | 234 |
| — | -149 | -500 | 233 | 43 | -381 | 399 | 106 | -626 | 210 | -466 | -720 | 275 | 394 | 45 | 96 | 359 | 117 | -369 | -294 | -249 | |
| S | -4 | -8959 | -10001 | -894 | -1115 | -701 | -1378 | * | * | | | | | | | | | | | | |
| 199 | 586 | -1572 | -3544 | -2956 | -1590 | -3074 | 1146 | 2056 | -2650 | -1471 | -821 | -2632 | -3183 | -2360 | -2616 | 749 | 2084 | 548 | -2078 | -1724 | 235 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 200 | -2565 | -3136 | -4632 | -4986 | -5541 | -3345 | -4711 | -5589 | -5217 | -5757 | -4891 | -3960 | 4126 | -4790 | -5030 | 313 | -3031 | -4352 | -5539 | -5556 | 236 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 201 | -5703 | -4637 | -6071 | -6422 | 4247 | -5850 | -2263 | -4601 | -6011 | -3891 | -3997 | -4657 | -5777 | -4789 | -5384 | -5276 | -5579 | -4785 | 3754 | -326 | 237 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 202 | -4004 | 1819 | -6101 | -6452 | -6291 | -4445 | -5640 | -6613 | -6356 | -6594 | -6013 | -5387 | 4217 | -6060 | -5930 | -4283 | -4452 | -5619 | -5713 | -6326 | 238 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 203 | -2055 | -2755 | -3361 | -3367 | -4891 | -2898 | -3513 | -4669 | -3448 | -4824 | -3929 | -2989 | 1088 | 626 | -3651 | 3161 | 980 | -3679 | -5000 | -4666 | 239 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |
| 204 | -193 | -2572 | -2289 | -1802 | -3389 | -2689 | -1973 | -3054 | -1673 | -3195 | -2366 | 391 | -7 | -1619 | 298 | 2877 | -1822 | 681 | -3505 | -2985 | 240 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |
| 205 | -3720 | -5665 | 1799 | 3574 | -5870 | -3397 | -2892 | -5933 | -3362 | -5739 | -5225 | -2010 | -3998 | -2600 | -4392 | -3318 | -3833 | -5362 | -5813 | -4781 | 241 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |
| 206 | -3187 | -2735 | -5771 | -5357 | -2928 | -5425 | -4775 | 3160 | -5193 | -346 | -1817 | -5066 | -5220 | -4927 | -5175 | -4693 | -3161 | 2014 | -4266 | 1730 | 242 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |
| 207 | -425 | -4169 | -5818 | -5963 | 3540 | -5593 | 689 | -3981 | -5531 | -714 | -3475 | -4373 | -5489 | -4453 | -5010 | -4803 | -4826 | -4062 | -1348 | 3430 | 243 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 208 | -3019 | -3434 | -3667 | -2884 | 380 | -3876 | -2081 | -3229 | -1261 | -3138 | 1161 | 1805 | -3948 | -1970 | 3574 | -3099 | -2906 | -3122 | -2846 | -2071 | 244 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 209 | -219 | 3939 | -4124 | -3631 | -2168 | -3133 | -2636 | 2196 | -3268 | -1998 | -1377 | -3062 | -3449 | 362 | -3170 | -2323 | 1989 | -1291 | -2679 | -2340 | 245 |
| — | -149 | -500 | 233 | 43 | -381 | 399 | 106 | -626 | 210 | -466 | -720 | 275 | 394 | 45 | 96 | 359 | 117 | -369 | -294 | -249 | |
| S | -4 | -8959 | -10001 | -894 | -1115 | -701 | -1378 | * | * | | | | | | | | | | | | |
| 210 | -4729 | -4070 | -7069 | -6474 | 605 | -6916 | -5347 | -1532 | -6280 | 3058 | 2235 | -6629 | -5792 | -4903 | -5682 | -6332 | -4543 | -2432 | -3801 | -3948 | 246 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 211 | 951 | -2633 | -4888 | -5223 | -5307 | -2899 | -4556 | -5134 | -5148 | -5391 | -4430 | -3649 | 3902 | -4616 | -4850 | -36 | -2496 | -3833 | -5522 | -5469 | 247 |
| — | -149 | -500 | 233 | 45 | -381 | 398 | 105 | -626 | 210 | -466 | -721 | 275 | 394 | 45 | 98 | 359 | 117 | -369 | -295 | -250 | |
| T | -96 | -3987 | -10001 | -984 | -1016 | -701 | -1378 | * | * | | | | | | | | | | | | |
| 212 | -1495 | -2002 | -2005 | -1444 | -2051 | -2697 | -1424 | -1636 | 152 | -936 | 1233 | -38 | -2774 | 215 | 945 | -635 | 749 | 2107 | 2763 | -1915 | 250 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 213 | −4303 | −4495 | −4995 | −3753 | −2154 | −4692 | 1241 | −4646 | −1331 | −4154 | −3768 | −3416 | −4635 | −2296 | 3965 | −4140 | −3982 | −4556 | −2596 | 873 | 251 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 214 | 830 | −2879 | 998 | 1610 | −3200 | −2379 | −1038 | −2951 | 1223 | −2895 | −1969 | 545 | −2473 | 1030 | 295 | −34 | 89 | −2501 | −3063 | −2380 | 252 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 215 | 526 | −2939 | 315 | 2774 | −3259 | −2415 | −1087 | −3010 | 147 | −2953 | −2030 | −1049 | −2518 | 1079 | -8 | −1340 | 23 | −2561 | −3120 | −2435 | 253 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 216 | −3774 | −3233 | −6377 | −5972 | −2638 | −6204 | −5637 | 3492 | −5879 | 1426 | −1384 | −5888 | −5660 | −5241 | −5738 | −5586 | −3723 | 8 | −4452 | −4403 | 254 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 217 | −4366 | −3775 | −6802 | −6245 | −2106 | −6588 | −5365 | 1174 | −6063 | 2930 | 1338 | −6301 | −5691 | −4907 | −5598 | −5954 | −4230 | 111 | −3928 | −4124 | 255 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 218 | −1424 | −2894 | 227 | 1737 | −3217 | −284 | −1050 | −2966 | 1433 | −1603 | −1984 | −1029 | −2487 | 1132 | 2024 | −1303 | −394 | −2517 | −3075 | −2395 | 256 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 219 | −518 | −2732 | −3752 | −4015 | −5238 | 3337 | −4093 | −5057 | −4401 | −5263 | −4337 | −3300 | −3689 | 372 | −4433 | 1109 | −2528 | −3851 | −5412 | −5210 | 257 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 220 | −4050 | −3540 | −6473 | −5903 | 76 | −6108 | −4927 | 80 | −5669 | 2372 | 1326 | −5798 | −5450 | −4696 | −5279 | −5383 | −3933 | 2337 | −3774 | −3871 | 258 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 221 | −1859 | 1451 | −4221 | −3607 | −1642 | −3435 | −2372 | 173 | −3221 | 2679 | -835 | −3103 | −3486 | −2847 | −3034 | −432 | −251 | 362 | −2222 | −1885 | 259 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 222 | 1076 | −3179 | 221 | -859 | −3503 | 1800 | 1595 | −3263 | −943 | −3208 | −2299 | 1429 | −2703 | 58 | −1472 | 1118 | −1646 | −2810 | −3381 | −2678 | 260 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 223 | 2382 | 4160 | −4265 | −4067 | −3686 | −2899 | −3505 | −3408 | −3870 | −3708 | −2954 | 453 | −3558 | −3573 | −3874 | −65 | −2269 | −2892 | −4073 | 1623 | 261 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 224 | −3393 | −5135 | 3567 | −1514 | −5677 | −3235 | −2777 | −5681 | −3214 | −5543 | −4967 | 2358 | −3845 | −2479 | −4201 | −3070 | 114 | −5041 | −5725 | −4634 | 262 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 225 | −3026 | −2715 | −5396 | −4787 | 1671 | −4751 | −3603 | 1117 | −4438 | 2460 | -831 | −4406 | −4552 | −3848 | 20 | −3891 | −2946 | 863 | −3077 | −2909 | 263 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 226 | −3291 | 1652 | −5950 | −5596 | −3300 | −5728 | −5502 | 2913 | −5518 | 836 | −2035 | −5383 | −5476 | −5375 | −5611 | −5064 | −3276 | 2254 | −4911 | −4475 | 264 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 227 | −30 | 1774 | −5323 | −5663 | −5339 | 3578 | −4680 | −5153 | −5339 | −5428 | −4470 | −3767 | −3749 | −4786 | −4952 | −2309 | −2531 | −3857 | −5537 | −5537 | 265 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 228 | −5012 | −4348 | −6180 | −6310 | 4410 | −5761 | −2814 | −2957 | −5946 | −2104 | 1335 | −4989 | −5655 | −4846 | −5401 | −5247 | −4977 | −3563 | −2032 | −927 | 266 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 229 | −3530 | −5058 | −1466 | 174 | −5153 | −3457 | 4489 | −5254 | −2091 | −5008 | −4396 | −2075 | −3924 | 3041 | −2386 | −3212 | −3529 | −4827 | −4883 | −4148 | 267 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 230 | −1871 | −2091 | 68 | −2131 | −2160 | −3069 | −2033 | 1465 | −2201 | −453 | −1334 | 294 | −3237 | −1998 | −2464 | −2199 | 3130 | −1332 | −2616 | −2199 | 268 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 231 | −1487 | −2908 | 913 | 1327 | 1312 | −2441 | −1118 | −2940 | 128 | −2911 | −2006 | −1084 | 1355 | −670 | −19 | −1374 | −1428 | −2518 | −3094 | 2726 | 269 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 232 | −1735 | −3247 | 2506 | 1092 | −3556 | −357 | 1103 | −3320 | −973 | −3258 | −2349 | 383 | −2728 | -882 | 1077 | 1091 | −1686 | −2864 | −3427 | −2716 | 270 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 233 | −4978 | −4425 | 926 | −4759 | 1647 | −337 | −2135 | −4407 | −5256 | −3836 | −3839 | −4034 | −5383 | −4255 | −5029 | −4678 | −4938 | −4483 | −1456 | 4397 | 271 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 234 | 2449 | 1598 | −2663 | −2089 | −1702 | −2893 | −1699 | −1258 | −364 | −415 | -899 | −2082 | −2969 | −1721 | −22 | −222 | 531 | 527 | −2132 | −1738 | 272 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 235 | −143 | −3043 | −1773 | 819 | −3340 | −2774 | −1336 | −3011 | −712 | -869 | −2157 | −1443 | −2852 | 661 | 3270 | −1739 | −1740 | −2662 | −3186 | 478 | 273 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 236 | −327 | −3575 | −2094 | −2415 | −4554 | −3206 | 4824 | −5156 | −3160 | −5142 | −4438 | 2290 | −3858 | −2954 | −3502 | −2766 | −3046 | −4315 | −4800 | −4018 | 274 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 237 | −6302 | −5253 | −6400 | −6761 | 4582 | −5634 | −4008 | −5872 | −6718 | −5174 | −5285 | −5914 | −5958 | −6033 | −6150 | −6368 | −6391 | −6027 | −3309 | −2287 | 275 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 238 | −489 | −2739 | −5542 | −4986 | 618 | −4977 | −3961 | 891 | −4689 | 2532 | −1090 | −4635 | −4768 | −4158 | −4480 | −4150 | −3036 | 1545 | −3426 | −3237 | 276 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 239 | −171 | −3125 | 212 | 357 | −3428 | −2542 | −1294 | −262 | −936 | −3141 | −2242 | −1183 | −2696 | 1591 | −1459 | 2693 | −1629 | −2742 | −3331 | −2639 | 277 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 240 | 711 | 4289 | −4221 | −3749 | −2216 | −3019 | −2673 | −1700 | −3397 | −440 | −1446 | −3064 | −3393 | −3042 | −3256 | 932 | 1624 | 140 | −2702 | −2371 | 278 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 241 | −92 | 4907 | −4590 | −4186 | −2494 | −3133 | −3029 | −1643 | −3808 | 230 | −1693 | −3330 | −3569 | −3422 | −3608 | 431 | −2071 | 912 | −3027 | −2705 | 279 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 242 | −1425 | 498 | −1274 | 679 | −3212 | −2397 | −1051 | −2959 | 404 | −2904 | −1980 | 793 | −2489 | 195 | 1434 | 2202 | 242 | −2512 | −3070 | −2393 | 280 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 243 | −2571 | −4077 | 478 | −1336 | −4438 | −3038 | 333 | −4199 | −1538 | −4085 | −3268 | 1254 | −3344 | −1550 | 3561 | −181 | −2541 | −3751 | −4204 | −3509 | 281 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 244 | −3106 | −2752 | −5524 | −427 | −2135 | −4957 | −3914 | 1874 | −4653 | 2204 | 2456 | −4611 | −4743 | −4107 | −4436 | −4124 | −3038 | 1007 | −3374 | −3201 | 282 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 245 | −1766 | −1712 | −3710 | −3139 | −1740 | 516 | −2198 | −1144 | −98 | 2429 | −950 | −2785 | −3320 | −2498 | −2629 | −2306 | 23 | 1085 | −2250 | −1904 | 283 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −177 | −8959 | −3142 | -894 | −1115 | −701 | −1378 | * | * | | | | | | | | | | | | |
| 246 | −307 | −2776 | 1344 | −611 | −3091 | 2102 | −951 | −2837 | 74 | −2790 | 659 | 900 | 606 | −495 | 325 | −1201 | −1259 | −2395 | −2964 | −2285 | 284 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −1808 | −8787 | −490 | −894 | −1115 | −1745 | −511 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 247 | 1293 | -809 | -1315 | -840 | -1256 | -1444 | -748 | -676 | -707 | -1089 | -383 | 924 | -1752 | -583 | -1012 | -562 | 1513 | 1420 | -1612 | -1187 | 285 |
| — | -149 | -500 | 233 | 43 | -381 | 399 | 106 | -626 | 210 | -466 | -720 | 275 | 394 | 45 | 96 | 359 | 117 | -369 | -294 | -249 | |
| . | -182 | -6996 | -3177 | -894 | -1115 | -3706 | -115 | * | * | | | | | | | | | | | | |
| 248 | -881 | -2428 | 2000 | 1862 | -2710 | -1341 | -383 | -2488 | -246 | -2452 | -1626 | 31 | -1683 | 9 | -859 | -683 | 1617 | -2042 | -2656 | -1872 | 286 |
| — | -149 | -500 | 233 | 43 | -381 | 399 | 106 | -626 | 210 | -466 | -720 | 275 | 394 | 45 | 96 | 359 | 117 | -369 | -294 | -249 | |
| . | -19 | -6833 | -7875 | -894 | -1115 | -3752 | -111 | * | * | | | | | | | | | | | | |
| 249 | 1391 | -607 | -2105 | -1637 | -964 | -1729 | -1171 | 1909 | -1411 | -612 | -85 | -1401 | -2025 | -1227 | -1540 | -898 | 1630 | 400 | -1525 | -1150 | 287 |
| — | -149 | -500 | 233 | 43 | -381 | 398 | 105 | -627 | 212 | -466 | -721 | 275 | 393 | 45 | 96 | 360 | 119 | -370 | -295 | -250 | |
| . | -1997 | -424 | -7875 | -75 | -4300 | -3752 | -111 | * | * | | | | | | | | | | | | |
| 250 | -1788 | -2524 | -2258 | -1114 | -3297 | -2356 | -348 | -2683 | 2280 | -2382 | -1700 | -1055 | -2327 | 69 | 3087 | -1677 | -1511 | -2440 | -2252 | -2110 | 289 |
| — | -148 | -501 | 234 | 42 | -378 | 397 | 104 | -627 | 209 | -467 | -722 | 274 | 394 | 47 | 97 | 358 | 118 | -364 | -296 | -246 | |
| . | -1031 | -1946 | -1994 | -3249 | -160 | -3752 | -111 | * | * | | | | | | | | | | | | |
| 251 | -1382 | -1651 | -2007 | -2241 | -3135 | 3558 | -2249 | -3310 | -2521 | -3382 | -2848 | -2021 | -2327 | -2362 | -2512 | -1597 | -1742 | -2656 | -2734 | -2979 | 301 |
| — | -149 | -500 | 233 | 43 | -381 | 399 | 106 | -626 | 210 | -466 | -720 | 275 | 394 | 45 | 96 | 359 | 117 | -369 | -294 | -249 | |
| . | -25 | -6424 | -7466 | -894 | -1115 | -3004 | -192 | * | * | | | | | | | | | | | | |
| 252 | -762 | -830 | -2463 | -2083 | -1101 | -2085 | -1635 | 2007 | -1790 | -447 | -157 | -1819 | -2377 | -1671 | -1883 | -1313 | 2599 | 631 | -1889 | -1499 | 302 |
| — | -149 | -500 | 233 | 43 | -381 | 399 | 106 | -626 | 210 | -466 | -720 | 275 | 394 | 45 | 96 | 359 | 117 | -369 | -294 | -249 | |
| . | -19 | -6799 | -7841 | -894 | -1115 | -68 | -4438 | * | * | | | | | | | | | | | | |
| 253 | 790 | -1430 | -3900 | -3269 | -1386 | -535 | -2013 | 286 | -2874 | 1961 | -633 | -2774 | -3191 | -2505 | -2689 | -291 | -1538 | 1298 | -1891 | 858 | 303 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 254 | -1406 | -2876 | 1900 | 1982 | -3196 | -406 | -1039 | -2946 | 401 | -817 | -1966 | -120 | -2473 | -579 | -253 | 41 | 421 | -1131 | -3060 | -2378 | 304 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 255 | 526 | -1482 | -3592 | -2983 | -1452 | -247 | -1964 | 964 | -2653 | -1341 | -692 | 167 | -3153 | -2341 | -2576 | -2163 | 2000 | 1508 | -1945 | 1833 | 305 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 256 | -1406 | -2840 | 294 | 1227 | -3144 | -376 | -1047 | -2883 | -633 | -92 | 220 | -1028 | -2479 | 373 | 1378 | 696 | 1332 | -707 | -3033 | -2360 | 306 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 257 | -1835 | -3213 | -1394 | -1073 | -3677 | 546 | 1910 | -3423 | 199 | -3378 | -2485 | 116 | 2249 | -1063 | -1582 | 2067 | -1816 | -2959 | -3548 | -2876 | 307 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 258 | -226 | -2881 | 1603 | 980 | -3202 | -475 | -1039 | -2953 | 1165 | -2897 | -1970 | 1960 | -2474 | 212 | 269 | -595 | 126 | -2503 | -3064 | -2381 | 308 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -574 | -8959 | -1616 | -894 | -1115 | -701 | -1378 | * | * | | | | | | | | | | | | |
| 259 | -1053 | -2420 | -943 | 426 | 478 | 698 | 1566 | -2422 | 694 | -406 | -1520 | -693 | -2132 | -254 | 2029 | 309 | -991 | -2021 | -2624 | -1972 | 309 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -134 | -8391 | -3543 | -894 | -1115 | -2728 | -236 | * | * | | | | | | | | | | | | |
| 260 | -992 | -2412 | 694 | 521 | -2717 | 1945 | -634 | -2454 | -230 | -2425 | -1516 | -603 | -2060 | -183 | 658 | 312 | 591 | 22 | -2615 | -1944 | 310 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -1015 | -8264 | -994 | -894 | -1115 | -2907 | -206 | * | * | | | | | | | | | | | | |
| 261 | -626 | -1575 | -657 | -144 | -1415 | -1646 | 2389 | -1392 | 58 | -1510 | -730 | -389 | -1745 | 1721 | -340 | -616 | 1724 | -1131 | -1637 | 1245 | 311 |
| — | -149 | -500 | 233 | 43 | -381 | 399 | 106 | -626 | 210 | -466 | -720 | 275 | 394 | 45 | 96 | 359 | 117 | -369 | -294 | -249 | |
| . | -314 | -7263 | -2402 | -894 | -1115 | -3615 | -123 | * | * | | | | | | | | | | | | |
| 262 | -1516 | -1257 | -3227 | -2851 | 145 | -2968 | -1113 | 2926 | -2461 | -342 | -164 | -2349 | -2966 | -2119 | -2359 | -2153 | -1476 | 141 | -633 | 2612 | 312 |
| — | -149 | -500 | 233 | 43 | -381 | 399 | 106 | -626 | 210 | -466 | -720 | 275 | 394 | 45 | 96 | 359 | 117 | -369 | -294 | -249 | |
| . | -17 | -6966 | -8008 | -894 | -1115 | -462 | -1868 | * | * | | | | | | | | | | | | |
| 263 | 461 | -2082 | -1453 | 92 | -2206 | 2000 | -1071 | 1022 | -810 | -2016 | -1242 | -1153 | -2451 | 1587 | -1244 | -497 | -1204 | -1597 | 2003 | -1888 | 313 |
| — | -149 | -500 | 233 | 43 | -381 | 399 | 106 | -626 | 210 | -466 | -720 | 275 | 394 | 45 | 96 | 359 | 117 | -369 | -294 | -249 | |
| . | -5 | -8649 | -9691 | -894 | -1115 | -211 | -2878 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 264 | -180 | -1484 | -148 | -3162 | -1451 | -3165 | 1009 | 329 | -2803 | 1454 | -687 | -2745 | -3215 | -2465 | -2676 | -2243 | -429 | 2441 | -1958 | -1610 | 314 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 265 | -1405 | -2876 | 303 | 1453 | -3196 | -2379 | -1037 | -2946 | 1155 | -2891 | -1965 | 454 | -2472 | -578 | 1053 | 970 | 781 | 95 | -3059 | -222 | 315 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 266 | 455 | -1553 | 56 | -2540 | 1476 | -3008 | -1830 | -1071 | -2285 | 357 | -750 | 286 | -3068 | -2045 | -2352 | -250 | -1508 | 223 | -1987 | 3140 | 316 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 267 | -1405 | -2859 | 620 | 238 | 353 | 981 | 797 | -2916 | 393 | -1443 | -1950 | 1276 | -2475 | 1448 | -1131 | -1289 | -1344 | -2476 | 1587 | 1749 | 317 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 268 | -2423 | 1210 | 1728 | -2287 | -5149 | 3119 | -3144 | -4993 | -3380 | -5065 | -4241 | 323 | -3659 | -2873 | -3942 | -163 | -2753 | -4068 | -5252 | -4633 | 318 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 269 | -1945 | -3303 | -1769 | 252 | 232 | -342 | -1380 | -3378 | 1046 | -3278 | -2405 | 1019 | -2921 | -934 | 3173 | -1823 | -1856 | -2969 | -3384 | -2814 | 319 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 270 | -226 | -2759 | 210 | -762 | -744 | -2406 | 515 | 671 | 1017 | -274 | -1861 | -27 | -2498 | 1025 | 292 | -116 | 1441 | -674 | -2973 | -2322 | 320 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -57 | -8959 | -4754 | -894 | -1115 | -701 | -1378 | * | * | | | | | | | | | | | | |
| 271 | -3010 | -2579 | -5603 | -5186 | 1264 | -5216 | -4665 | 2101 | -5014 | -2059 | -1891 | -4875 | -5072 | -4816 | -5019 | -4471 | 1075 | 2862 | -4295 | -3856 | 321 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8906 | -9948 | -894 | -1115 | -1124 | -886 | * | * | | | | | | | | | | | | |
| 272 | -179 | -2570 | 127 | -813 | -527 | -2411 | -1084 | -2462 | 307 | 126 | -1688 | 874 | -2501 | -669 | 1509 | 889 | 555 | 266 | -2821 | -127 | 322 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8906 | -9948 | -894 | -1115 | -1124 | -886 | * | * | | | | | | | | | | | | |
| 273 | -2244 | 649 | -4672 | -4106 | -2144 | -498 | -3013 | 1118 | -3767 | 162 | -1251 | -3646 | -3995 | -3440 | -3622 | -3118 | -21 | 3104 | -2841 | -2477 | 323 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8906 | -9948 | -894 | -1115 | -1124 | -886 | * | * | | | | | | | | | | | | |
| 274 | 6 | -2795 | 984 | 272 | 172 | 1465 | -1012 | -349 | 1377 | -2803 | 577 | -994 | -2444 | -558 | 858 | -520 | -1309 | -2406 | -2990 | -2320 | 324 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8906 | -9948 | -894 | -1115 | -1124 | -886 | * | * | | | | | | | | | | | | |
| 275 | 2342 | -1428 | -3852 | -3227 | 217 | -3126 | -2005 | 937 | -2844 | -1273 | -636 | -2751 | -3182 | -2484 | -2676 | 1099 | -1532 | 873 | -1892 | 418 | 325 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8906 | -9948 | -894 | -1115 | -1124 | -886 | * | * | | | | | | | | | | | | |
| 276 | -403 | -1395 | -3880 | -3247 | 2700 | -3108 | -1972 | 404 | -2849 | 1121 | -592 | -2744 | -3158 | -2476 | -2659 | -244 | -149 | -804 | -1840 | 2352 | 326 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8906 | -9948 | -894 | -1115 | -1124 | -886 | * | * | | | | | | | | | | | | |
| 277 | -116 | -2654 | -3846 | -4018 | -4871 | -2878 | 1379 | -4683 | -4045 | -4907 | -4035 | -3265 | 3912 | -3830 | -4057 | -2253 | 214 | -3657 | -5079 | -4825 | 327 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8906 | -9948 | -894 | -1115 | -1124 | -886 | * | * | | | | | | | | | | | | |
| 278 | -3303 | -2790 | -5999 | -5701 | -3491 | -5835 | -5976 | 3382 | -5683 | -2228 | -2173 | -5520 | -5582 | -5659 | -5871 | -5235 | -3300 | 2407 | -5302 | -4763 | 328 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8906 | -9948 | -894 | -1115 | -1124 | -886 | * | * | | | | | | | | | | | | |
| 279 | -2249 | -2846 | -4590 | -4951 | -5426 | 3363 | -4589 | -5352 | -5175 | -5564 | -4640 | -3742 | -3872 | -4652 | -4946 | 1745 | -2721 | -4062 | -5513 | -5517 | 329 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8906 | -9948 | -894 | -1115 | -1124 | -886 | * | * | | | | | | | | | | | | |
| 280 | -3241 | -2751 | -5935 | -5625 | -3474 | -5690 | -5770 | 3486 | -5582 | -2250 | -2170 | -5404 | -5491 | -5541 | -5743 | -5062 | 33 | 1922 | -5195 | -4666 | 330 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8906 | -9948 | -894 | -1115 | -1124 | -886 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 281 | −3448 | −5532 | 3490 | 967 | −5628 | −3187 | 2135 | −5627 | −3049 | −5455 | −4889 | 1445 | −3776 | −2323 | −4059 | −3048 | −3547 | −5064 | −5657 | −4515 | 331 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8906 | −9948 | -894 | −1115 | −1124 | -886 | * | * | | | | | | | | | | | | |
| 282 | −394 | −1470 | −3470 | −2870 | −1455 | −3022 | −1921 | −993 | −2556 | −1344 | 1974 | −2548 | 2175 | −2260 | −2512 | 628 | 883 | 1718 | −1942 | 403 | 332 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8906 | −9948 | -894 | −1115 | −1124 | -886 | * | * | | | | | | | | | | | | |
| 283 | 513 | −2834 | 983 | 1204 | −289 | 1233 | −1004 | −2899 | 367 | −2849 | −1924 | −16 | 884 | −546 | −1094 | −1252 | 157 | −2454 | −3020 | 134 | 333 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8906 | −9948 | -894 | −1115 | −1124 | -886 | * | * | | | | | | | | | | | | |
| 284 | 486 | −2840 | −39 | 282 | 23 | −2340 | 834 | −2911 | 1004 | −2856 | −1929 | 895 | −2434 | 1241 | 1932 | 45 | −418 | −2462 | −3023 | −2340 | 334 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8906 | −9948 | -894 | −1115 | −488 | −1801 | * | * | | | | | | | | | | | | |
| 285 | −4008 | −3514 | −6417 | −5837 | 2692 | −6018 | −4818 | 2407 | −5587 | 1525 | 1534 | −5706 | −5394 | −4631 | −5199 | −5276 | −3890 | 108 | −3713 | −3793 | 335 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 286 | 418 | −2708 | 854 | 1407 | −2958 | −2420 | −1087 | 993 | −700 | 35 | −1816 | −1087 | −2512 | 979 | 294 | −1334 | 621 | −2291 | −2935 | 550 | 336 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 287 | −134 | −2892 | −350 | 1468 | −3214 | −2388 | 1143 | −2964 | 948 | −2908 | −1982 | −108 | −2483 | −589 | 1680 | 1612 | −1358 | −2515 | −3075 | −2392 | 337 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 288 | 599 | 1293 | 58 | −1387 | 210 | 942 | −1398 | 986 | −1259 | −1930 | −1199 | −1569 | −2751 | 1501 | 177 | −162 | 204 | 58 | −2401 | −1931 | 338 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 289 | 1342 | 2126 | −3821 | −3212 | −1494 | −3120 | −2066 | −997 | −680 | 1883 | −735 | −2759 | −3210 | −2502 | −2704 | −278 | −1584 | 1224 | −1995 | −1650 | 339 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 290 | 1145 | −2875 | −1258 | 412 | 120 | −375 | −1042 | −2942 | 1881 | −2890 | −1965 | 1273 | −2477 | −583 | 807 | 383 | −1349 | −2496 | −3060 | −2379 | 340 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | -80 | -8959 | −4259 | -894 | −1115 | −701 | −1378 | * | * | | | | | | | | | | | | |
| 291 | −1353 | −2813 | 796 | −657 | −3128 | −2329 | −988 | −2875 | 1414 | −148 | −1903 | 1044 | −2422 | 251 | −148 | 1470 | 920 | -872 | −2999 | −2320 | 341 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −5 | -8883 | −9925 | -894 | −1115 | −433 | −1948 | * | * | | | | | | | | | | | | |
| 292 | −229 | −2893 | 1240 | 967 | −3213 | 626 | −1054 | −2962 | 996 | −2908 | −1984 | −1026 | 2006 | −595 | 267 | −1303 | −1363 | −348 | −3077 | −2395 | 342 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 293 | 587 | −2907 | 237 | 756 | −3227 | −2395 | −1062 | −2978 | 763 | −2923 | −1998 | 430 | 1305 | −604 | −1157 | 1755 | 189 | −2529 | −3091 | −2406 | 343 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 294 | −2879 | −2497 | −5404 | −4919 | 539 | −4908 | −4120 | 1305 | −4674 | −407 | −1654 | −4557 | −4798 | −4384 | −4596 | −4105 | 1558 | 2976 | −3800 | −3432 | 344 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 295 | 370 | −2871 | 226 | 241 | −3190 | −2379 | −1038 | −1100 | 804 | −1200 | 1709 | 368 | −133 | 1903 | 269 | 598 | −1343 | −1080 | −3056 | −2375 | 345 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 296 | −592 | −2876 | −1251 | 1909 | −3197 | −2378 | 1064 | −2948 | 736 | -828 | −1966 | −156 | −133 | 1553 | 269 | 793 | −258 | −2498 | −3060 | −2377 | 346 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 297 | −3595 | −4303 | −4315 | −2919 | −5108 | −4155 | 1508 | −4451 | 2972 | −4110 | −3432 | −2818 | −4080 | −1612 | 2163 | −3472 | −138 | −4221 | 3248 | −3839 | 347 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 298 | 493 | −1459 | −60 | −3180 | −1420 | −3147 | −2014 | 1814 | −2811 | 629 | 1455 | −2742 | −3197 | −2464 | 431 | −2226 | −411 | 1756 | −1925 | −1579 | 348 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 299 | 1357 | −3099 | −1577 | 923 | −3460 | −2638 | −1219 | −3172 | 2211 | -807 | −2193 | −1276 | −2718 | 1902 | 370 | −1576 | −1616 | −2746 | −3223 | −2609 | 349 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 300 | −1420 | −2694 | −1352 | 2197 | 254 | −2426 | −1094 | −2636 | 291 | −394 | 92 | −1097 | −2517 | 2016 | -86 | 268 | −1359 | −393 | −2924 | −2292 | 350 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 301 | −518 | −2939 | −5981 | −5545 | −2710 | −5637 | −4996 | 2462 | −5381 | 2406 | −1502 | −5313 | −5327 | −4934 | −5285 | −4922 | −3367 | 590 | −4257 | −4057 | 351 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 302 | −2088 | −3418 | −1984 | 484 | −3852 | −2968 | −1443 | −3512 | 2417 | −3379 | −2517 | 405 | −3034 | 1740 | 2285 | −704 | −1983 | −3108 | −3450 | −2924 | 352 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 303 | −231 | −2905 | 993 | 1943 | −3225 | −2392 | −1059 | −2977 | 1029 | −2921 | −1995 | −158 | −2491 | 1884 | −1153 | 300 | 492 | −2527 | −3088 | −2403 | 353 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 304 | −146 | −2883 | 241 | 842 | −3204 | −2385 | −1043 | −2954 | 1210 | 36 | −1973 | −1021 | −2479 | 877 | 2258 | 233 | −1352 | −2505 | −3066 | −2385 | 354 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 305 | −3120 | −2804 | −5031 | −4657 | 3180 | −4449 | −2105 | 15 | −28 | 830 | −1933 | −3763 | −4437 | −3626 | −3947 | −3573 | −3048 | −2303 | 2608 | 2671 | 355 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −712 | -8959 | −1367 | -894 | −1115 | −701 | −1378 | * | * | | | | | | | | | | | | |
| 306 | −1289 | −2731 | -888 | 1373 | −3077 | 1791 | -833 | −2809 | −344 | −2738 | −1843 | −784 | 563 | 1766 | 1336 | −1157 | −1228 | −2373 | −2885 | −2232 | 356 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −7 | -8254 | -9296 | -894 | −1115 | −124 | −3597 | * | * | | | | | | | | | | | | |
| 307 | −565 | −2880 | −1267 | −717 | −3199 | 783 | −1046 | −2947 | 1767 | −1296 | −1970 | 2225 | −2483 | 655 | 660 | −54 | −345 | −2501 | −3063 | −2384 | 357 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −282 | -8959 | −2508 | -894 | −1115 | −701 | −1378 | * | * | | | | | | | | | | | | |
| 308 | −1559 | −3051 | 1811 | −700 | −3373 | 1724 | −1132 | −3127 | 1766 | −3061 | −2157 | 583 | 211 | −688 | 388 | −1417 | −1506 | −2677 | −3222 | −2528 | 358 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −641 | -8682 | −1488 | -894 | −1115 | −2108 | −381 | * | * | | | | | | | | | | | | |
| 309 | -873 | 1938 | −976 | −420 | −1997 | −1939 | −618 | −157 | 1581 | −1782 | −979 | 596 | −2025 | 865 | 975 | -872 | 86 | 1093 | −2133 | −1576 | 359 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −3213 | -8048 | −171 | -894 | −1115 | −962 | −1039 | * | * | | | | | | | | | | | | |
| 310 | −1504 | −2255 | −1920 | −994 | −2666 | −2307 | −492 | −2161 | 1922 | −2083 | 3560 | −1035 | −2307 | −98 | 1976 | −1470 | −1316 | −1949 | −2211 | −1929 | 360 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −15 | −7173 | -8215 | -894 | −1115 | −74 | −4325 | * | * | | | | | | | | | | | | |
| 311 | −1843 | −3098 | −1811 | −1197 | 321 | −2791 | 1110 | −705 | 3142 | −3061 | −2206 | −1451 | −2860 | 606 | 449 | −243 | −1755 | −2731 | −3219 | −2663 | 361 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 312 | −3094 | −2676 | −5638 | −5185 | −2803 | −5221 | −4524 | 2052 | −4976 | 2077 | −1660 | 40 | −5047 | −4668 | −4915 | −4455 | −3062 | 2055 | −4078 | −3746 | 362 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 313 | −3722 | −3199 | −6300 | −5866 | −2572 | −6072 | −5389 | 3404 | −5740 | 395 | 2641 | −5746 | −5563 | −5098 | −5576 | −5413 | −3666 | 496 | −4313 | −4261 | 363 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 314 | −2928 | −2609 | −5320 | −4741 | 433 | −4690 | −3543 | 1586 | −4407 | 1948 | −985 | −4332 | −4532 | −3876 | −4179 | −3835 | −2859 | 2174 | −3067 | 855 | 364 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 315 | –2015 | 2237 | –4968 | –5073 | –5157 | 3142 | –4333 | –4949 | –4502 | –5185 | –4255 | –3605 | –3695 | –4321 | 261 | 1434 | –2475 | –3759 | –5337 | –5246 | 365 |
| — | –149 | –500 | 233 | 43 | –381 | 399 | 106 | –626 | 210 | –466 | –720 | 275 | 394 | 45 | 96 | 359 | 117 | –369 | –294 | –249 | |
| E | –4 | -8959 | –10001 | -894 | –1115 | –701 | –1378 | * | * | | | | | | | | | | | | |
| 316 | –141 | –1651 | –3278 | –2671 | –1654 | –3093 | 1024 | –180 | –2267 | –1517 | -868 | –2482 | –3166 | –2130 | 1986 | –2156 | 207 | 2664 | –2123 | –1760 | 366 |
| — | –149 | –500 | 233 | 43 | –381 | 399 | 106 | –626 | 210 | –466 | –720 | 275 | 394 | 45 | 96 | 359 | 117 | –369 | –294 | –249 | |
| — | –4 | -8959 | –10001 | -894 | –1115 | –701 | –1378 | * | * | | | | | | | | | | | | |
| 317 | –3588 | –5621 | 3927 | 164 | –5802 | –166 | –2778 | –5830 | –3251 | –5648 | –5120 | –1886 | –3894 | –2480 | –4304 | –3187 | –3705 | –5245 | –5820 | –4685 | 367 |
| — | –149 | –500 | 233 | 43 | –381 | 399 | 106 | –626 | 210 | –466 | –720 | 275 | 394 | 45 | 96 | 359 | 117 | –369 | –294 | –249 | |
| — | –4 | -8959 | –10001 | -894 | –1115 | –701 | –1378 | * | * | | | | | | | | | | | | |
| 318 | –3384 | –4365 | 1274 | –2368 | –5088 | –3832 | –2062 | –4518 | 410 | –4205 | –3505 | –2468 | –3919 | 1755 | 3500 | –3211 | –3162 | –4226 | –4097 | –3856 | 368 |
| — | –149 | –500 | 233 | 43 | –381 | 399 | 106 | –626 | 210 | –466 | –720 | 275 | 394 | 45 | 96 | 359 | 117 | –369 | –294 | –249 | |
| B | –4 | -8959 | –10001 | -894 | –1115 | –701 | –1378 | * | * | | | | | | | | | | | | |
| 319 | –309 | –3178 | –5913 | –5296 | 1008 | –5336 | –4124 | –1352 | –4974 | 2767 | 2097 | –5008 | –4954 | –4189 | –4637 | –4510 | –3452 | 71 | –3336 | –3303 | 369 |
| — | –149 | –500 | 233 | 43 | –381 | 399 | 106 | –626 | 210 | –466 | –720 | 275 | 394 | 45 | 96 | 359 | 117 | –369 | –294 | –249 | |
| — | –4 | -8959 | –10001 | -894 | –1115 | –701 | –1378 | * | * | | | | | | | | | | | | |
| 320 | –3574 | –4646 | 4049 | –2255 | –5845 | –3598 | –3418 | –5940 | –3891 | –5875 | –5307 | –2580 | –4233 | –3178 | –4704 | –3428 | 56 | –5196 | –5710 | –5088 | 370 |
| — | –149 | –500 | 233 | 43 | –381 | 399 | 106 | –626 | 210 | –466 | –720 | 275 | 394 | 45 | 96 | 359 | 117 | –369 | –294 | –249 | |
| G | –4 | -8959 | –10001 | -894 | –1115 | –701 | –1378 | * | * | | | | | | | | | | | | |
| 321 | –1502 | –1954 | –2080 | 10 | –1993 | –2723 | –1458 | 670 | 131 | –393 | 1861 | –1670 | –138 | –1269 | 530 | –174 | –1441 | –1418 | –2336 | 3174 | 371 |
| — | –149 | –500 | 233 | 43 | –381 | 399 | 106 | –626 | 210 | –466 | –720 | 275 | 394 | 45 | 96 | 359 | 117 | –369 | –294 | –249 | |
| G | –4 | -8959 | –10001 | -894 | –1115 | –701 | –1378 | * | * | | | | | | | | | | | | |
| 322 | –151 | –1495 | –4010 | –3381 | 1550 | –3238 | –2122 | 2448 | –2986 | –203 | –703 | –2880 | –3285 | –2617 | –2797 | 974 | 95 | 964 | –1989 | –1645 | 372 |
| — | –149 | –500 | 233 | 43 | –381 | 399 | 106 | –626 | 210 | –466 | –720 | 275 | 394 | 45 | 96 | 359 | 117 | –369 | –294 | –249 | |
| G | –4 | -8959 | –10001 | -894 | –1115 | –701 | –1378 | * | * | | | | | | | | | | | | |
| 323 | –3766 | 1634 | –4758 | –3140 | –5020 | –4275 | –2098 | –4501 | 3383 | –4156 | –3507 | –2965 | –4191 | –1690 | 1978 | –3657 | –3419 | –4299 | –3950 | 744 | 373 |
| — | –149 | –500 | 233 | 43 | –381 | 399 | 106 | –626 | 210 | –466 | –720 | 275 | 394 | 45 | 96 | 359 | 117 | –369 | –294 | –249 | |
| — | –4 | -8959 | –10001 | -894 | –1115 | –701 | –1378 | * | * | | | | | | | | | | | | |
| 324 | –3425 | –3945 | –3781 | –4164 | –5971 | 3711 | –4650 | –6240 | –5119 | –6240 | –5534 | 517 | –4617 | –4644 | –5247 | –3601 | –3843 | –5153 | –5649 | –5756 | 374 |
| — | –149 | –500 | 233 | 43 | –381 | 399 | 106 | –626 | 210 | –466 | –720 | 275 | 394 | 45 | 96 | 359 | 117 | –369 | –294 | –249 | |
| H | –4 | -8959 | –10001 | -894 | –1115 | –701 | –1378 | * | * | | | | | | | | | | | | |
| 325 | –3261 | –2780 | –5900 | –5526 | –3201 | –5637 | –5297 | 2641 | –5421 | 1245 | –1961 | –5294 | –5400 | –5236 | –5477 | –4952 | –14 | 2333 | –4739 | –4333 | 375 |
| — | –149 | –500 | 233 | 43 | –381 | 399 | 106 | –626 | 210 | –466 | –720 | 275 | 394 | 45 | 96 | 359 | 117 | –369 | –294 | –249 | |
| H | –4 | -8959 | –10001 | -894 | –1115 | –701 | –1378 | * | * | | | | | | | | | | | | |
| 326 | –1407 | –2840 | 191 | –721 | –3144 | –2387 | 796 | –173 | 407 | –2848 | –1933 | –1029 | 2321 | 444 | 204 | 780 | 782 | –334 | –3033 | –2361 | 376 |
| — | –149 | –500 | 233 | 43 | –381 | 399 | 106 | –626 | 210 | –466 | –720 | 275 | 394 | 45 | 96 | 359 | 117 | –369 | –294 | –249 | |
| H | –4 | -8959 | –10001 | -894 | –1115 | –701 | –1378 | * | * | | | | | | | | | | | | |
| 327 | –1451 | –2887 | –1314 | 860 | –3203 | –2425 | 1192 | –2940 | 679 | 212 | –1980 | –1065 | –2516 | 2928 | 385 | –153 | –1388 | –371 | –3068 | –2403 | 377 |
| — | –149 | –500 | 233 | 43 | –381 | 399 | 106 | –626 | 210 | –466 | –720 | 275 | 394 | 45 | 96 | 359 | 117 | –369 | –294 | –249 | |
| H | –4 | -8959 | –10001 | -894 | –1115 | –701 | –1378 | * | * | | | | | | | | | | | | |
| 328 | –3719 | –4356 | –4571 | –3066 | –5272 | –210 | –2088 | –4546 | 3433 | –4182 | 1204 | –2918 | –4159 | –1668 | 1768 | –3602 | –3385 | –4326 | –4014 | –3944 | 378 |
| — | –149 | –500 | 233 | 43 | –381 | 399 | 106 | –626 | 210 | –466 | –720 | 275 | 394 | 45 | 96 | 359 | 117 | –369 | –294 | –249 | |
| H | –4 | -8959 | –10001 | -894 | –1115 | –701 | –1378 | * | * | | | | | | | | | | | | |
| 329 | –4633 | –4000 | –6997 | –6392 | 1848 | –6803 | –5359 | 1123 | –6191 | 2794 | 1093 | –6529 | –5743 | –4869 | –5622 | –6188 | –4455 | –2358 | –3832 | –4061 | 379 |
| — | –149 | –500 | 233 | 43 | –381 | 399 | 106 | –626 | 210 | –466 | –720 | 275 | 394 | 45 | 96 | 359 | 117 | –369 | –294 | –249 | |
| H | –4 | -8959 | –10001 | -894 | –1115 | –701 | –1378 | * | * | | | | | | | | | | | | |
| 330 | –1597 | –1859 | –2475 | –178 | –1873 | –2884 | 2558 | 535 | 48 | 1278 | 1220 | –1949 | –2950 | –1530 | 1877 | –1889 | –1532 | –1309 | 1286 | –1848 | 380 |
| — | –149 | –500 | 233 | 43 | –381 | 399 | 106 | –626 | 210 | –466 | –720 | 275 | 394 | 45 | 96 | 359 | 117 | –369 | –294 | –249 | |
| H | –4 | -8959 | –10001 | -894 | –1115 | –701 | –1378 | * | * | | | | | | | | | | | | |
| 331 | 3358 | 1792 | –5345 | –5669 | –5272 | –2886 | –4637 | –5072 | –5298 | –5352 | –4392 | –3721 | –3701 | –4740 | –4910 | 731 | –2470 | –3789 | –5504 | –5476 | 381 |
| — | –149 | –500 | 233 | 43 | –381 | 399 | 106 | –626 | 210 | –466 | –720 | 275 | 394 | 45 | 96 | 359 | 117 | –369 | –294 | –249 | |
| H | –4 | -8959 | –10001 | -894 | –1115 | –701 | –1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 332 | −4982 | −4198 | −6050 | −6138 | 3630 | −5838 | −2373 | −3072 | −5737 | 19 | 2124 | −4659 | −5589 | −4573 | −5178 | −5073 | −4846 | −3590 | −1609 | 3021 | 382 |
| — | −149 | −500 | 233 | 43 | −381 | 399 | 106 | −626 | 210 | −466 | −720 | 275 | 394 | 45 | 96 | 360 | 117 | −369 | −294 | −249 | |
| H | -86 | −4140 | −10001 | −197 | −2973 | −701 | −1378 | * | * | | | | | | | | | | | | |
| 333 | −3108 | −4583 | −1489 | 3539 | −5033 | −768 | −2258 | −4749 | −1698 | −4558 | −3832 | −1938 | −3688 | 621 | 323 | −2859 | −3075 | −4319 | −4606 | −3978 | 384 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 334 | −227 | −2709 | −1346 | 280 | −2959 | −2425 | 1269 | −989 | 896 | 47 | −1818 | −1092 | −2516 | 940 | 1984 | −1339 | 121 | 757 | −2936 | −2301 | 385 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 335 | −4913 | −4208 | −6635 | −6424 | 3785 | −6383 | −3682 | −1998 | −6156 | 2018 | −1271 | −5698 | −5762 | −4885 | −5572 | −5848 | −4761 | −2825 | −2728 | −1859 | 386 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 336 | −488 | −3682 | −6571 | −5984 | −99 | −6181 | −4896 | 254 | −5734 | 3084 | -809 | −5890 | −5476 | −4672 | −5290 | −5461 | −4066 | −2080 | −3694 | −3776 | 387 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 337 | −144 | −2792 | −1293 | 2073 | −3076 | −1083 | −1061 | 417 | −656 | −912 | −1891 | −136 | −2490 | 1062 | 1039 | 270 | −259 | −688 | −2998 | −2338 | 388 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 338 | 151 | −2877 | 654 | 1516 | −3198 | −406 | 1186 | −2948 | 898 | −2893 | 959 | −1013 | −2471 | 1553 | 699 | −1284 | 545 | −2499 | −3060 | −2377 | 389 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 339 | −4671 | −4277 | −4945 | −4712 | 954 | −5276 | 3348 | −4193 | −4050 | −3690 | −3597 | 2461 | −5218 | −3787 | 1089 | −4442 | −4551 | −4238 | −1417 | 3179 | 390 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −4 | -8959 | −10001 | -894 | −1115 | −701 | −1378 | * | * | | | | | | | | | | | | |
| 340 | −619 | −2226 | −2773 | −548 | −2674 | −2881 | −2296 | −2257 | −2343 | −2554 | −1845 | −2367 | 3717 | −2197 | −2597 | −685 | −1914 | −57 | 1145 | −2635 | 391 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −4 | -8959 | −10001 | -894 | −1115 | −701 | −1378 | * | * | | | | | | | | | | | | |
| 341 | −255 | −3030 | −1257 | 2981 | −3351 | −2472 | 535 | −3102 | 980 | −3042 | −2124 | −20 | −2589 | 628 | −1245 | −549 | −1493 | −2653 | −3207 | −2521 | 392 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −4 | -8959 | −10001 | -894 | −1115 | −701 | −1378 | * | * | | | | | | | | | | | | |
| 342 | −1650 | −1627 | −3232 | −2636 | 604 | −3087 | 1032 | −1147 | −579 | 478 | 651 | −2447 | −3143 | 282 | 18 | −2136 | −1589 | −1055 | 4638 | 1812 | 393 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 343 | −1507 | −2587 | 128 | −981 | −2781 | −2541 | 2027 | 1085 | −77 | −1285 | −1715 | −1251 | −2626 | 688 | 2630 | −1472 | −1442 | 318 | −2845 | −2269 | 394 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 344 | −3441 | −5465 | 1837 | 1202 | −5604 | 2991 | −2647 | −5577 | 10 | −5413 | −4818 | −1811 | −3803 | −2333 | −3943 | −3058 | −3532 | −5023 | −5609 | −4508 | 395 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 345 | −1827 | −3214 | −1717 | 213 | −3602 | −2751 | 1239 | −3298 | 3017 | −3197 | −2308 | 321 | −2825 | 712 | 859 | −1705 | 45 | −2876 | −3305 | −2719 | 396 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 346 | −2945 | −2617 | −5600 | −5244 | −3257 | −4895 | −4760 | 1559 | −5066 | −2289 | −2091 | −4796 | −4972 | −4881 | −5068 | -882 | −132 | 3385 | −4492 | −4053 | 397 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | -86 | -8959 | −4166 | -894 | −1115 | −701 | −1378 | * | * | | | | | | | | | | | | |
| 347 | −1621 | −1704 | −2921 | −2315 | −1722 | −2989 | −1783 | 224 | 144 | −1574 | −915 | −2240 | −3061 | −1841 | 76 | −170 | 699 | 2926 | −2158 | −1782 | 398 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −5 | -8878 | −9920 | -894 | −1115 | −422 | −1979 | * | * | | | | | | | | | | | | |
| 348 | −4262 | −3725 | −6207 | −5849 | 811 | −5836 | −3335 | −1845 | −5524 | 2927 | −1196 | −5133 | −5378 | −4503 | −5069 | −5063 | −4134 | −76 | −2498 | 1711 | 399 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 349 | −3266 | −2781 | −5912 | −5545 | −3248 | −5663 | −5365 | 2486 | −5450 | 1067 | −1999 | −5318 | −5424 | −5286 | −5521 | −4984 | −160 | 2605 | −4805 | −4383 | 400 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 350 | −166 | −3350 | −2812 | −2418 | −4236 | −3351 | −2264 | −3674 | −178 | −3789 | −3075 | −2460 | −3650 | 4157 | −1438 | −2633 | −2637 | −170 | −3975 | −3627 | 401 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 351 | −2918 | −2521 | −5469 | −5014 | −2935 | −5010 | −4338 | 3060 | −4797 | −412 | −1831 | −4668 | 70 | −4566 | −4762 | −4230 | 86 | 2167 | −4040 | −3633 | 402 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 352 | 2480 | 2217 | −4919 | −4844 | −4012 | −25 | −3922 | −3635 | −4514 | −3965 | −3196 | −3508 | −3615 | −4091 | −4314 | −61 | 1821 | 890 | −4393 | −4161 | 403 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 353 | −127 | −2015 | −2003 | −1445 | −2077 | −2691 | −1435 | 1048 | 216 | −1920 | −1195 | 1330 | 1291 | −1215 | −1684 | 561 | 99 | 1560 | −2399 | −1936 | 404 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −4 | -8959 | −10001 | -894 | −1115 | −701 | −1378 | * | * | | | | | | | | | | | | |
| 354 | −1503 | −2856 | −1346 | 199 | −3168 | 39 | −1161 | −2889 | 944 | −789 | −1992 | −1136 | 3015 | −720 | −1243 | -82 | 21 | −2483 | −3093 | −2440 | 405 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 355 | 1385 | −2639 | −3275 | −2921 | −4408 | −2800 | −2991 | −4145 | −392 | −4281 | −3387 | −2694 | 215 | −2687 | −3109 | 2640 | 1651 | −3340 | −4501 | −4086 | 406 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 356 | 1135 | −2226 | −3200 | −2637 | −2644 | −2989 | −2268 | −2138 | −2059 | −630 | −1789 | −2503 | −3297 | −2163 | 3297 | 222 | −1949 | 6 | −2992 | −2618 | 407 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 357 | −1410 | −2878 | −1253 | 897 | 115 | 1658 | −1043 | −2945 | 165 | −2893 | −1968 | 458 | −642 | 1824 | −1133 | 968 | −344 | −2499 | −3063 | −2381 | 408 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 358 | −1418 | −2892 | 2458 | 243 | −3213 | −351 | −1048 | −2964 | 396 | −1467 | −1982 | 465 | −2482 | 797 | 1306 | 451 | −1357 | −2514 | −3075 | −2391 | 409 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 359 | −1558 | −1587 | −2991 | −2407 | −1567 | 693 | 1135 | 346 | −2170 | −1449 | 1281 | 1075 | −443 | −1952 | −2281 | −350 | −1500 | 2447 | −2027 | −1653 | 410 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 360 | −1439 | −2899 | −1291 | 2180 | −3223 | −2410 | −1060 | −2968 | 1173 | −1404 | −1990 | −1046 | 1131 | 644 | 1066 | −65 | −1376 | −2523 | −3077 | 538 | 411 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −304 | -8959 | −2411 | -894 | −1115 | −701 | −1378 | * | * | | | | | | | | | | | | |
| 361 | −54 | −2903 | 1448 | 2434 | −3214 | −2318 | −1073 | 17 | −715 | −2926 | −2025 | −962 | 253 | −631 | −1239 | 817 | −1406 | −2525 | −3114 | −2421 | 412 |
| — | −149 | −500 | 233 | 43 | −381 | 399 | 106 | −626 | 210 | −466 | −720 | 275 | 394 | 48 | 96 | 359 | 117 | −369 | −294 | −249 | |
| H | −223 | −3795 | −3812 | −192 | −3008 | −2170 | −363 | * | * | | | | | | | | | | | | |
| 362 | −2413 | −2410 | −4487 | −4279 | −1248 | −3607 | −2402 | −1491 | −3881 | −2285 | −1934 | −3459 | −3947 | −3513 | −3714 | −2873 | 415 | 1488 | −1954 | 4259 | 414 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −6 | -8556 | −9598 | -894 | −1115 | −1519 | −619 | * | * | | | | | | | | | | | | |
| 363 | −1726 | −3082 | −1465 | 775 | −3453 | −2596 | −1177 | 38 | −528 | −3057 | −2188 | 666 | −2698 | 3418 | 1421 | −1603 | −1643 | −2737 | −3178 | −2597 | 415 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −5 | -8660 | −9702 | -894 | −1115 | −1270 | −772 | * | * | | | | | | | | | | | | |
| 364 | -87 | −2739 | 808 | 1361 | −3060 | −2240 | -899 | −2811 | 905 | −2755 | −1828 | 1992 | −2333 | −439 | 438 | 64 | 684 | −2361 | −2923 | −193 | 416 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −5 | -8757 | −9799 | -894 | −1115 | −272 | −2539 | * | * | | | | | | | | | | | | |
| 365 | 624 | −1429 | −3849 | −322 | −1382 | −3129 | 1002 | 283 | −2833 | 2003 | 1213 | −2746 | −3179 | −2472 | −2664 | −2210 | −1530 | 504 | −1885 | 1469 | 417 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 366 | −1515 | −2947 | −1380 | 1348 | −3274 | −2480 | −1112 | −3006 | 27 | 486 | −2040 | −1120 | −2569 | 1694 | 2231 | −14 | 236 | −2574 | −3113 | −2459 | 418 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 367 | 488 | −2881 | −1255 | 371 | −3202 | −2382 | 1069 | −2953 | 1089 | −2896 | −1970 | 1162 | −136 | 730 | 1414 | 1306 | −1347 | −2503 | −3063 | −2381 | 419 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 368 | −649 | −2877 | 197 | 1594 | −3197 | −2380 | 1065 | −2947 | 406 | −2893 | −1967 | −1016 | −2474 | 2517 | −1128 | −61 | 440 | 441 | −3061 | −2379 | 420 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 369 | −3249 | −2761 | −5908 | −5556 | −3372 | −5675 | −5467 | 2599 | −5475 | −509 | −2109 | −5331 | −5449 | −5372 | −5583 | −5006 | 1312 | 2654 | −4945 | −4467 | 421 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 370 | −227 | −2865 | −1260 | 1794 | −3179 | −2384 | 1330 | −2925 | 1029 | −2878 | 1400 | 2029 | −2478 | −587 | −1132 | 231 | −1348 | −2483 | −3052 | 627 | 422 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 371 | −487 | −2866 | 1211 | 2235 | −3182 | −2382 | −1041 | −688 | 397 | −1274 | −1957 | 1121 | −2475 | −583 | 991 | −1289 | −1345 | −717 | −3053 | −2373 | 423 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 372 | −1710 | −1591 | −3668 | −410 | −1543 | −3230 | −2088 | 1383 | −2738 | 1876 | −754 | −2740 | −3275 | 1164 | −2678 | −2302 | 1305 | 592 | −2073 | −1724 | 424 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 373 | 1594 | −2759 | −5429 | −5530 | −4215 | −3610 | −4931 | −1477 | −5326 | −3330 | −3093 | −4247 | −4281 | −4983 | −5140 | −2993 | −2846 | 3419 | −5241 | −4942 | 425 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 374 | −143 | −2903 | 984 | 371 | −3223 | 2258 | −1057 | −2974 | 523 | −2918 | −1993 | 460 | −2490 | 724 | −198 | −1306 | 25 | −2524 | −3086 | −2401 | 426 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 375 | −201 | −3100 | −1551 | 738 | −3462 | −2624 | 1176 | −3178 | 452 | −3095 | −2193 | −1261 | −2706 | 724 | 3108 | −113 | −1606 | −2747 | −3225 | −2605 | 427 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 376 | −3377 | −2887 | −6050 | −5764 | −3432 | −5781 | −5900 | 3877 | −5721 | −2168 | −2149 | −5546 | −5585 | −5630 | −5857 | −5194 | −3384 | 633 | −5198 | −4712 | 428 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 377 | −3445 | −3927 | −3531 | −3854 | −4319 | −3947 | −4080 | −720 | −4336 | −4917 | −4613 | 4329 | −4588 | −4187 | −4465 | −3614 | −3797 | −4144 | −4687 | −4031 | 429 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 378 | −2893 | −4364 | −1230 | 1405 | −5063 | 2595 | −2483 | −4925 | −2543 | −4840 | −4090 | −1836 | −3609 | 591 | −3217 | 1892 | −3003 | −4336 | −5017 | −4152 | 430 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 379 | 410 | −2951 | −1423 | 1787 | −3276 | −2510 | −1132 | −2999 | 1635 | −415 | 1195 | −1152 | −2596 | 162 | 1788 | −1431 | −1475 | −2576 | −3115 | −2473 | 431 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 380 | −5166 | −4310 | −5900 | −6122 | 3460 | −5702 | −2092 | −4121 | −5688 | -88 | −3578 | −4435 | −5587 | −4535 | −5123 | 124 | −5049 | −4253 | −1351 | 3454 | 432 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 381 | −11 | −2606 | −5124 | −5443 | −5306 | 3437 | −4598 | −5126 | −5228 | −5385 | −4415 | −3680 | −3697 | −4674 | −4887 | 523 | −225 | −3813 | −5527 | −5494 | 433 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −4 | -8959 | −10001 | -894 | −1115 | −701 | −1378 | * | * | | | | | | | | | | | | |
| 382 | −228 | −2885 | −1260 | 288 | −3207 | −2387 | −1045 | −2956 | 414 | −2900 | −1975 | 1770 | −2481 | 646 | 543 | 658 | 2210 | −2508 | −3067 | −2387 | 434 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 383 | −708 | −1484 | 835 | −2873 | −1447 | −3073 | 391 | 1172 | −2560 | 1457 | −684 | −2566 | 319 | −2265 | −2516 | -857 | −1520 | 1762 | −1936 | −1582 | 435 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 384 | −306 | −3357 | 2056 | 1588 | −3675 | 1144 | −1428 | −3445 | −1103 | −3382 | −2481 | 484 | −2812 | −989 | −1646 | 845 | 222 | −2985 | −3554 | −2832 | 436 |
| — | −149 | −500 | 233 | 43 | −381 | 399 | 106 | −626 | 210 | −466 | −720 | 275 | 394 | 45 | 96 | 360 | 117 | −369 | −294 | −249 | |
| B | −2524 | −4236 | −371 | −207 | −2902 | −701 | −1378 | * | * | | | | | | | | | | | | |
| 385 | −514 | −928 | −1238 | −693 | −1113 | 635 | −490 | 1955 | −109 | -893 | −236 | −751 | −1799 | −293 | 1620 | −730 | −498 | −370 | −1421 | −1004 | 438 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −19 | −6826 | −7868 | -894 | −1115 | −166 | −3202 | * | * | | | | | | | | | | | | |
| 386 | −149 | −3783 | −5474 | −5433 | 2448 | −5229 | 1338 | −3536 | −5043 | −3287 | −3082 | −4131 | −5161 | −4148 | −4649 | 200 | −4264 | −3561 | 4174 | 3240 | 439 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | -8878 | −9920 | -894 | −1115 | −422 | −1979 | * | * | | | | | | | | | | | | |
| 387 | −1425 | −2718 | −1348 | −121 | −2970 | −2427 | 1139 | −2672 | 1106 | −2703 | 881 | −1094 | −2518 | 1419 | −1188 | −74 | 1808 | 1544 | −2943 | −2307 | 440 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 388 | −6266 | −5465 | −6390 | −6767 | −6968 | −5461 | −6137 | −7956 | −6975 | −7412 | −7278 | −6614 | 4329 | −6836 | −6484 | −6639 | −6570 | −7422 | −5831 | −6936 | 441 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 389 | −3403 | −2891 | −6064 | −5714 | −3187 | −5884 | −5676 | 2672 | −5653 | −402 | 1138 | −5540 | −5565 | −5436 | −5728 | −5244 | −3383 | 2880 | −4910 | −4557 | 442 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 390 | −1546 | −1684 | −2675 | −56 | −1675 | −2904 | 3309 | 885 | −1881 | −1550 | 1252 | −2086 | −2970 | 446 | −22 | −1921 | −1486 | 1832 | −2106 | 596 | 443 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 391 | −5497 | −4483 | −5986 | −6299 | 2732 | −5848 | 3660 | −4370 | −5855 | 1135 | −3784 | −4490 | −5706 | −4614 | −5239 | −5090 | −5354 | −4534 | −1335 | 2732 | 444 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 392 | −2905 | −2619 | −5258 | −4635 | 1447 | −4572 | −3392 | 2059 | −4273 | 1864 | 1876 | −4226 | −4403 | −3684 | −4006 | −3699 | −2822 | 115 | −2903 | 1667 | 445 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 393 | −1431 | −2879 | 1369 | 305 | −3187 | −2399 | 3324 | −2931 | −652 | -861 | −1971 | 1416 | −2496 | −610 | 202 | −1314 | 132 | −2494 | −3068 | 1485 | 446 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 394 | −1424 | −2891 | −1274 | 305 | −3213 | -809 | 1144 | −2961 | 946 | −2905 | 963 | −1032 | −2489 | 2282 | 2175 | −48 | −263 | −2514 | −3070 | −2393 | 447 |
| — | −149 | −500 | 233 | 43 | −381 | 399 | 106 | −626 | 210 | −466 | −720 | 275 | 394 | 45 | 98 | 359 | 117 | −369 | −294 | −249 | |
| — | −182 | −4140 | −4010 | −197 | −2973 | −701 | −1378 | * | * | | | | | | | | | | | | |
| 395 | −1359 | −2821 | 626 | −659 | −3140 | −2331 | 1134 | −2886 | 393 | −263 | −1911 | −968 | 1775 | 788 | 366 | 1719 | −1298 | −2442 | −3003 | −2326 | 449 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | -8868 | −9910 | -894 | −1115 | −403 | −2036 | * | * | | | | | | | | | | | | |
| 396 | 560 | −2285 | −4952 | −4355 | 413 | −4267 | −3187 | 1147 | −4001 | 1938 | 750 | −3918 | −4190 | −3548 | −3796 | −3391 | −2496 | 1966 | −2861 | −2598 | 450 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 397 | −152 | −3018 | 2235 | 307 | −3334 | 348 | −1149 | −3090 | −16 | −3032 | −2112 | 421 | 1820 | 347 | −1270 | 17 | −1475 | −2638 | −3200 | −2507 | 451 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 398 | −2076 | −2543 | −2654 | −1997 | 2824 | −3191 | −1678 | −2220 | 272 | −2415 | −1722 | −2086 | 980 | −1503 | 1935 | −2223 | −371 | −2062 | −2556 | 2190 | 452 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 399 | 807 | −2876 | 1888 | 951 | 334 | −2378 | 585 | −2947 | 332 | −1278 | −1965 | −52 | −642 | 712 | 211 | 134 | −1343 | −2498 | −3060 | −2377 | 453 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 400 | −633 | −2962 | 785 | 2589 | −3221 | −2525 | −1254 | −2928 | -897 | 37 | −2075 | −1179 | −2661 | 1579 | −1407 | −1510 | −1561 | 489 | −3182 | −2521 | 454 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 401 | −1786 | −1636 | −3906 | −3278 | 464 | −3296 | −2045 | −1096 | 539 | 2055 | −782 | −2845 | −3337 | −2533 | −492 | −2379 | −1724 | 296 | −1919 | 2710 | 455 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 402 | 562 | 1721 | −3932 | −3296 | 536 | −3136 | −2007 | 2243 | −2892 | 970 | 1217 | −2781 | −3186 | −2515 | −2692 | -886 | −402 | −3 | −1873 | 778 | 456 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 403 | 3192 | −2676 | −4054 | −4120 | −5090 | −226 | −3971 | −4878 | −168 | −5077 | −4153 | −3316 | −3649 | −3839 | −4103 | 1046 | −2459 | −3745 | −5240 | −5036 | 457 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 404 | −188 | −2079 | −4642 | −4018 | 533 | −3899 | −2724 | 279 | −3632 | 2578 | −739 | −3541 | −3859 | −3167 | −3407 | −3001 | −2234 | −361 | −2427 | 1901 | 458 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 405 | −2378 | −2160 | −4466 | −3948 | 2382 | −3826 | −2052 | −1667 | −3557 | 867 | 1168 | −228 | −3853 | −3092 | −3342 | −729 | −2315 | −1614 | −1631 | 3546 | 459 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 406 | 1562 | 2126 | −1700 | −1145 | −2355 | −2577 | −1281 | −1971 | 304 | −2170 | 963 | −282 | −2663 | −961 | 1378 | 699 | 123 | 385 | −2579 | −2060 | 460 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 407 | 1214 | −1531 | −3214 | 167 | −1501 | −3023 | −1852 | 1735 | −2347 | 71 | −728 | 280 | −3081 | −2096 | 32 | −2073 | −1507 | 1506 | −1975 | 630 | 461 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 408 | 2422 | −2546 | −4325 | −4169 | −4490 | −234 | −3797 | −4204 | −4009 | −4459 | −3610 | −3301 | −3582 | −3719 | −4062 | 2307 | 341 | −3375 | −4757 | 898 | 462 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 409 | −3498 | −5578 | 3733 | 929 | −5682 | −3239 | −2680 | −5674 | −116 | −5500 | −4934 | 542 | −3827 | −2371 | −4073 | −3099 | −3596 | −5112 | −5702 | −4566 | 463 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 410 | 978 | 3347 | −5396 | −4926 | −2861 | −4901 | −4180 | 1351 | −4693 | 189 | −1783 | −4560 | −4814 | −4447 | −4639 | −4107 | −2825 | 2544 | −3903 | −3501 | 464 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 411 | 869 | 3896 | −3951 | −3318 | 920 | 344 | −2042 | −916 | −2917 | 1056 | 1286 | −2809 | −3215 | −2541 | −2723 | −2250 | −1561 | −10 | −1908 | −1568 | 465 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 412 | −2190 | 1597 | −4548 | −3924 | 1051 | −3797 | −2667 | 1556 | −3539 | 2128 | −761 | −3445 | −3776 | −3103 | −3325 | −2899 | −2126 | 1092 | 1992 | −2118 | 466 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 413 | −3286 | −2802 | −194 | −5516 | −3515 | −5693 | −5695 | 1810 | −5557 | −2310 | −2224 | −5344 | −5511 | −5492 | −5733 | −5074 | −3286 | 3417 | −5200 | −4661 | 467 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 414 | −2602 | −3716 | 52 | −1795 | −5026 | −3028 | −2726 | −4876 | −2853 | −4872 | −4078 | 2506 | −3601 | −2403 | −3505 | 1815 | 2614 | −4134 | −5060 | −4298 | 468 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 415 | 1318 | −2621 | −4968 | −5275 | −5295 | −2891 | −4553 | −5118 | −5140 | −5374 | −4410 | −3653 | 2467 | −4612 | −4842 | 2769 | −2482 | −3819 | −5511 | −5461 | 469 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 416 | −3197 | −2757 | −5769 | −5329 | −2832 | −5385 | −4745 | 1360 | −5146 | 2065 | −1656 | −5046 | −5170 | −4817 | −5090 | −4640 | 1402 | 2039 | −4213 | −3909 | 470 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 417 | −156 | −3805 | −4986 | −4361 | −5616 | −3936 | −3474 | −5380 | −2289 | −5218 | −4553 | −3860 | −4444 | −3180 | 4087 | −3480 | −3561 | −4683 | −4923 | −4969 | 471 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −4 | -8959 | −10001 | -894 | −1115 | −701 | −1378 | * | * | | | | | | | | | | | | |
| 418 | −3714 | −5676 | 3799 | 1651 | −5870 | −3388 | −2883 | −5933 | −3358 | −5739 | −5227 | −1998 | −3990 | −2591 | −4397 | −3309 | −3827 | −5360 | −5823 | −4776 | 472 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 419 | −2415 | −3002 | −4640 | −5006 | −5541 | 3690 | −4691 | −5502 | −5275 | −5698 | −4792 | −3872 | −4012 | −4763 | −5056 | -88 | −2886 | −4224 | −5577 | −5613 | 473 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 420 | −3047 | −2717 | −5410 | −4824 | −2082 | −4846 | −3767 | 389 | −319 | 60 | 4775 | −4479 | −4653 | −3964 | −4242 | −4003 | −2977 | 284 | −3280 | −3100 | 474 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 421 | −2522 | −3221 | −2846 | −3220 | −5260 | −3176 | −3861 | −5424 | −4219 | −5535 | −4717 | 4172 | −3919 | −3735 | −4485 | 683 | −2943 | −4287 | −5400 | −4960 | 475 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 422 | −2564 | −2404 | −4686 | −4197 | −1983 | −4085 | −3182 | 461 | −3830 | 2811 | −1004 | 197 | −4131 | −3457 | −3683 | −3253 | 909 | −1287 | −2930 | −2670 | 476 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 423 | −2985 | −2585 | −5523 | −5052 | −2774 | −5065 | −4323 | 409 | −4827 | −295 | 1280 | −4716 | −4924 | −4528 | −4758 | −4280 | 1575 | 3149 | −3946 | −3598 | 477 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 424 | 2470 | 2243 | −5284 | −5553 | −5220 | −2881 | −4581 | −5019 | −5203 | −5287 | −4334 | −3695 | 1977 | −4669 | −4855 | 1864 | −2459 | −3765 | −5454 | −5410 | 478 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 425 | −4250 | −3838 | −5154 | −4879 | 267 | −5124 | 2520 | −3572 | 2147 | 858 | −3089 | −3986 | −5068 | −3816 | −3988 | −4282 | −4145 | −3595 | −1429 | 3428 | 479 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 426 | −3450 | −4892 | −1603 | 3560 | −5376 | −3485 | −2387 | −5045 | 871 | −4784 | −4128 | −2092 | −3878 | 500 | −1903 | −3157 | −3393 | −4650 | −4766 | −4210 | 480 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 427 | −317 | −4460 | −5948 | −6272 | 2394 | −5742 | −2102 | −4420 | −5845 | −3777 | −3846 | −4478 | −5664 | −4621 | −5239 | −5002 | −5282 | −4554 | −1354 | 4424 | 481 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 428 | −273 | −2719 | −5833 | −5488 | −3406 | −5443 | −5318 | 2482 | −5387 | −2293 | −2159 | −5192 | −5330 | −5284 | −5478 | −4766 | 203 | 2953 | −4896 | −4405 | 482 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 429 | 2214 | −1537 | −3967 | −3354 | −1535 | −3222 | −2158 | 906 | −2976 | −1394 | −768 | −2873 | −3295 | −2621 | −2814 | −1005 | 129 | 2030 | −2054 | 643 | 483 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 430 | 1055 | 4610 | −4356 | −3854 | −2108 | −3184 | −2686 | 395 | −3481 | −1935 | −1320 | −3173 | −3486 | −3111 | −3303 | −597 | 655 | 883 | −2635 | −2299 | 484 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −4 | -8959 | −10001 | -894 | −1115 | −701 | −1378 | * | * | | | | | | | | | | | | |
| 431 | −2827 | −3916 | −2902 | −2099 | −4531 | −3569 | −1786 | −4046 | 1196 | −3808 | −3032 | 466 | −3585 | 3466 | 1909 | 148 | −2644 | −3712 | −3764 | −3440 | 485 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 432 | −1406 | −2879 | 832 | 784 | −328 | −2379 | −1038 | −2951 | 423 | −2895 | −1969 | 473 | −2473 | 2442 | 1463 | 580 | −389 | −2501 | −3063 | −2380 | 486 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 433 | −664 | −3212 | 1946 | 1299 | −3522 | 1201 | 1216 | −3284 | 1359 | −3223 | −2313 | −1174 | 794 | -854 | −1470 | −1564 | −1655 | −2830 | −3392 | −2684 | 487 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −1281 | -8959 | −770 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 434 | −654 | −1977 | 897 | 1071 | −2237 | −1646 | −316 | −1948 | 74 | −46 | 1762 | 830 | −1741 | 121 | −423 | 376 | 972 | −1566 | −2197 | −1552 | 488 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −740 | −7689 | −1335 | -894 | −1115 | −3409 | −143 | * | * | | | | | | | | | | | | |
| 435 | −497 | −1377 | -889 | −488 | −2291 | −1387 | −621 | −1978 | −106 | −2058 | −1240 | −594 | 2470 | −257 | 1165 | 1397 | −612 | −1510 | −2276 | −1782 | 489 |
| — | −147 | −502 | 233 | 42 | −380 | 400 | 103 | −626 | 211 | −463 | −718 | 277 | 392 | 43 | 94 | 360 | 116 | −368 | −297 | −251 | |
| . | −1141 | -882 | -8008 | −2967 | −197 | −3715 | −114 | * | * | | | | | | | | | | | | |
| 436 | −1069 | −2728 | 2095 | 1448 | −2981 | −1429 | −514 | −2801 | −430 | −2721 | −1902 | 2043 | 1093 | −126 | −1082 | -837 | −1070 | −2326 | −2907 | −2075 | 499 |
| — | −149 | −500 | 233 | 43 | −381 | 399 | 106 | −626 | 210 | −466 | −720 | 275 | 394 | 45 | 96 | 359 | 117 | −369 | −294 | −249 | |
| . | −17 | −6966 | -8008 | -894 | −1115 | −3715 | −114 | * | * | | | | | | | | | | | | |
| 437 | −647 | −1559 | 1891 | −76 | 1806 | −1472 | −432 | −1517 | −336 | −1659 | −922 | −328 | −1740 | −168 | -816 | 1443 | −663 | −1233 | −1729 | −988 | 500 |
| — | −148 | −500 | 234 | 43 | −381 | 398 | 105 | −627 | 210 | −464 | −721 | 275 | 393 | 45 | 96 | 360 | 117 | −370 | −295 | −250 | |
| . | −2130 | −381 | -8008 | −67 | −4459 | −2877 | −211 | * | * | | | | | | | | | | | | |
| 438 | 1808 | 3097 | −2604 | −2203 | −1479 | −1551 | −1567 | -825 | −1947 | −1330 | −664 | −1639 | 1687 | −1687 | −1981 | −793 | −663 | 1013 | −1930 | −1594 | 502 |
| — | −149 | −500 | 233 | 43 | −381 | 399 | 106 | −626 | 210 | −466 | −720 | 275 | 394 | 45 | 96 | 359 | 117 | −369 | −294 | −249 | |
| S | −14 | −7234 | -8276 | -894 | −1115 | −447 | −1909 | * | * | | | | | | | | | | | | |
| 439 | −1869 | −3221 | 296 | −1096 | −3622 | −2717 | −1251 | −3306 | 2147 | −3187 | −2324 | 1389 | −2811 | -808 | 2638 | −1739 | −1775 | −2899 | −3270 | 849 | 503 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | -8685 | −9727 | -894 | −1115 | −227 | −2777 | * | * | | | | | | | | | | | | |
| 440 | −1418 | −2892 | 304 | 326 | −3212 | 422 | 1950 | −2963 | 2087 | −2907 | −1982 | 795 | 721 | −590 | −1140 | −1298 | 194 | −2513 | −3075 | 520 | 504 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 441 | 311 | −2747 | −3274 | −3175 | −4824 | 3111 | −3329 | −4598 | −3189 | −4726 | −3818 | 392 | −3534 | −3060 | 35 | 979 | −2377 | −3630 | −4895 | −4526 | 505 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 442 | 959 | −1799 | −3772 | −3251 | −2028 | −3000 | −2389 | −1544 | −2956 | −1916 | 1885 | −2811 | 1713 | −2664 | −2928 | 637 | 660 | 2112 | −2503 | −2156 | 506 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 443 | −4356 | −3760 | −6817 | −6287 | −2155 | −6626 | −5475 | 26 | −6120 | 3151 | −917 | −6354 | −5733 | −4978 | −5673 | −6021 | −4232 | 122 | −3998 | −4184 | 507 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 444 | −3421 | −2900 | −6099 | −5768 | −3269 | −5952 | −5868 | 3092 | −5731 | 636 | −1974 | −5610 | −5624 | −5554 | −5841 | −5335 | −3404 | 2336 | −5059 | −4676 | 508 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 445 | −4365 | −3822 | −6755 | −6286 | −2172 | −6368 | −5383 | −1340 | −6078 | 3142 | −958 | −6256 | −5681 | −4973 | −5626 | −5823 | −4272 | 786 | −3976 | −4104 | 509 |
| — | −149 | −500 | 233 | 43 | −381 | 399 | 106 | −626 | 210 | −466 | −720 | 275 | 394 | 45 | 96 | 359 | 117 | −369 | −294 | −249 | |
| E | −4 | -8959 | −10001 | -894 | −1115 | −701 | −1378 | * | * | | | | | | | | | | | | |
| 446 | −3394 | −3819 | −5347 | −5705 | −5881 | −4005 | −5224 | −6253 | −5855 | −6292 | −5576 | −4737 | −4729 | −5485 | −5568 | 3744 | −3850 | −5118 | −5593 | −5835 | 510 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 447 | −3523 | −4810 | −1835 | 3642 | −5378 | −3600 | −2386 | −5009 | −1539 | −4724 | −4074 | −2229 | −3950 | 510 | 296 | −3255 | −3436 | −4643 | −4657 | −4202 | 511 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 448 | −5422 | −4815 | −5974 | −6079 | 4459 | −5417 | −3157 | −5084 | −5052 | −4431 | −4484 | −5079 | −5664 | −4979 | 298 | −5391 | −5492 | −5208 | −2514 | −1401 | 512 |
| — | −149 | −500 | 233 | 43 | −381 | 399 | 106 | −626 | 210 | −466 | −720 | 275 | 394 | 45 | 96 | 359 | 117 | −369 | −294 | −249 | |
| B | −4 | -8959 | −10001 | -894 | −1115 | −701 | −1378 | * | * | | | | | | | | | | | | |
| 449 | 2274 | −2044 | −4328 | −3901 | −2530 | −3115 | −2951 | 1252 | −3582 | −2339 | −1721 | −3215 | −3539 | −3251 | −3483 | 658 | 2014 | 66 | −3046 | −2713 | 513 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −4 | -8959 | −10001 | -894 | −1115 | −701 | −1378 | * | * | | | | | | | | | | | | |
| 450 | −120 | −3074 | −4990 | −5351 | −5637 | 3698 | −4839 | −5566 | −5454 | −5769 | −4876 | −4040 | −4097 | −4951 | −5167 | −2759 | −2980 | −4302 | −5612 | −5753 | 514 |
| — | −149 | −500 | 233 | 43 | −381 | 399 | 106 | −626 | 210 | −466 | −720 | 275 | 394 | 45 | 96 | 359 | 117 | −369 | −294 | −249 | |
| G | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 451 | 2387 | 3873 | -5315 | -5584 | -5170 | -2881 | -4575 | -4951 | -5214 | -5230 | -4288 | -3699 | -3690 | -4674 | -4855 | 1451 | 1070 | -3735 | -5415 | -5365 | 515 |
| — | -149 | -500 | 233 | 43 | -381 | 399 | 106 | -626 | 210 | -466 | -720 | 275 | 394 | 45 | 96 | 359 | 117 | -369 | -294 | -249 | |
| G | -4 | -8959 | -10001 | -894 | -1115 | -701 | -1378 | * | * | | | | | | | | | | | | |
| 452 | 2968 | -2644 | -4650 | -4839 | -4299 | -2939 | -4140 | -4687 | -4743 | -4916 | -4079 | -3562 | -3717 | -4320 | -4573 | 2017 | -2501 | -3667 | -4716 | 929 | 516 |
| — | -149 | -500 | 233 | 43 | -381 | 399 | 106 | -626 | 210 | -466 | -720 | 275 | 394 | 45 | 96 | 359 | 117 | -369 | -294 | -249 | |
| G | -4 | -8959 | -10001 | -894 | -1115 | -701 | -1378 | * | * | | | | | | | | | | | | |
| 453 | 498 | -2879 | 300 | 319 | -3200 | -2380 | -1040 | -2950 | -621 | -2895 | -1969 | 1118 | 1070 | 2227 | 210 | 752 | -1347 | -328 | -3063 | -2380 | 517 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 454 | -1723 | -1660 | -3423 | 1825 | -1619 | -3209 | -2054 | 279 | -2560 | 249 | 1282 | -2622 | -3257 | -2301 | -2590 | 2048 | -1665 | 761 | -2145 | -1787 | 518 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 455 | -5647 | -4878 | -6611 | -6689 | -3480 | -5830 | -5714 | -3122 | -6613 | 3375 | -2416 | -6629 | -5924 | -5899 | -6106 | -6640 | -5628 | -3921 | -4748 | -4938 | 519 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 456 | -79 | -2873 | -1253 | -704 | -3193 | -226 | 1173 | -2942 | 842 | -827 | -1963 | 2159 | 1 | 647 | 269 | 781 | 31 | -2495 | -3058 | -2376 | 520 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -519 | -8959 | -1737 | -894 | -1115 | -701 | -1378 | * | * | | | | | | | | | | | | |
| 457 | 306 | -3147 | 2543 | 1240 | -3449 | -2 | 1604 | -3225 | -884 | -3162 | -2275 | -926 | -2533 | -737 | -1445 | 971 | -1572 | -2765 | -3337 | -2597 | 521 |
| — | -149 | -500 | 233 | 43 | -381 | 399 | 106 | -626 | 210 | -466 | -720 | 275 | 394 | 45 | 96 | 359 | 117 | -369 | -294 | -249 | |
| S | -6 | -8447 | -9489 | -894 | -1115 | -153 | -3314 | * | * | | | | | | | | | | | | |
| 458 | 2092 | -2633 | -3029 | -2908 | -4004 | 2611 | 1399 | -3683 | -3022 | -3911 | -3114 | 254 | -3465 | -2828 | -3303 | -2165 | -2274 | -132 | -4249 | -3841 | 522 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -707 | -8959 | -1376 | -894 | -1115 | -701 | -1378 | * | * | | | | | | | | | | | | |
| 459 | 3124 | -1891 | -4246 | -4339 | -4026 | -2240 | -3598 | -3426 | -4087 | -3963 | -3160 | -2920 | -3011 | -3665 | -3890 | 1080 | -1761 | 672 | -4357 | -4185 | 523 |
| — | -149 | -500 | 233 | 43 | -381 | 399 | 106 | -626 | 210 | -466 | -720 | 275 | 394 | 45 | 96 | 359 | 117 | -369 | -294 | -249 | |
| . | -7 | -8259 | -9301 | -894 | -1115 | -125 | -3590 | * | * | | | | | | | | | | | | |
| 460 | -2403 | -2144 | -4784 | -4191 | -1909 | -4092 | -3003 | 2986 | -3831 | 1239 | -1000 | -3736 | 32 | -3418 | -3642 | -3211 | -2345 | 393 | -2731 | 1645 | 524 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 461 | -2065 | -1855 | -4382 | -3770 | -1797 | -309 | -2603 | 2073 | -3348 | 1894 | -942 | -3315 | -3703 | -3026 | 1162 | -2792 | -2011 | 993 | -2449 | -2117 | 525 |
| — | -149 | -500 | 233 | 43 | -381 | 399 | 106 | -626 | 210 | -466 | -720 | 275 | 394 | 45 | 96 | 359 | 117 | -369 | -294 | -249 | |
| E | -4 | -8959 | -10001 | -894 | -1115 | -701 | -1378 | * | * | | | | | | | | | | | | |
| 462 | -3291 | -2799 | -5988 | -5680 | -3536 | -5753 | -5848 | 1958 | -5641 | -2310 | -2228 | -5463 | -5549 | -5609 | -5809 | -5127 | -15 | 3361 | -5269 | -4732 | 526 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 463 | -5484 | -5242 | -4990 | -5367 | -6389 | -5108 | -5499 | -7466 | -6086 | -7077 | -6801 | 4440 | -5645 | -5816 | -5991 | -5668 | -5796 | -6829 | -5673 | -6139 | 527 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 464 | -6266 | -5465 | -6390 | -6767 | -6968 | -5461 | -6137 | -7956 | -6975 | -7412 | -7278 | -6614 | 4329 | -6836 | -6484 | -6639 | -6570 | -7422 | -5831 | -6936 | 528 |
| — | -149 | -500 | 233 | 43 | -381 | 399 | 106 | -626 | 210 | -466 | -720 | 275 | 394 | 45 | 96 | 359 | 117 | -369 | -294 | -249 | |
| T | -4 | -8959 | -10001 | -894 | -1115 | -701 | -1378 | * | * | | | | | | | | | | | | |
| 465 | -5648 | -4559 | -6016 | -6375 | 1072 | -5900 | 1373 | -4533 | -5929 | -3838 | -3935 | -4506 | -5753 | -4647 | -5290 | -5148 | -5496 | -4689 | 5559 | 2896 | 529 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -4 | -8959 | -10001 | -894 | -1115 | -701 | -1378 | * | * | | | | | | | | | | | | |
| 466 | -302 | -5045 | 3423 | -1534 | -5682 | -3229 | -2795 | -5683 | -3241 | -5551 | -4969 | 2706 | -3844 | -2499 | -4230 | -3057 | -3529 | -5022 | -5734 | -4652 | 530 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |
| 467 | -1594 | -1441 | -3800 | -3173 | -1399 | -3127 | -1992 | 2143 | -2797 | -218 | -643 | -2727 | -3178 | -2449 | -115 | 516 | 1624 | 357 | -1900 | 2101 | 531 |
| — | -149 | -500 | 233 | 43 | -381 | 399 | 106 | -626 | 210 | -466 | -720 | 275 | 394 | 45 | 96 | 359 | 117 | -369 | -294 | -249 | |
| H | -4 | -8959 | -10001 | -894 | -1115 | -701 | -1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 468 | −1416 | −2883 | 1702 | 1735 | −3201 | −2386 | −1049 | −924 | 883 | −2898 | −1974 | 993 | −2482 | −590 | −1140 | 1018 | −345 | −343 | −3068 | −2387 | 532 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 469 | 1114 | −2918 | 643 | 2045 | −3238 | 368 | 799 | −2990 | 318 | −2934 | −2009 | 155 | −2501 | −611 | 1017 | −1320 | −1382 | −2540 | −3101 | −2416 | 533 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 470 | −1614 | 1551 | −3956 | −3321 | 1146 | −3165 | −2039 | -895 | −2919 | 610 | 1814 | −2810 | −3213 | −2543 | −2721 | -849 | 1343 | 2302 | −1903 | −1562 | 534 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 471 | 2865 | −2999 | 274 | −1499 | −3908 | −2709 | −1926 | −3655 | 139 | −3670 | −2783 | −1724 | −3050 | −1520 | −2120 | 820 | 408 | −3100 | −3870 | −3238 | 535 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 472 | 203 | −3055 | 1299 | 2392 | −3371 | −1124 | −1178 | −3128 | 354 | −3069 | −2150 | 1275 | −2597 | 1043 | −1308 | −658 | −1509 | −2675 | −3237 | −2541 | 536 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 473 | 2799 | −2525 | −4780 | −4732 | −4532 | −148 | −4066 | −4 | −4480 | −4507 | −3671 | −3488 | −3629 | −4100 | −4369 | 1790 | 193 | −3373 | −4837 | −4637 | 537 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 474 | −2979 | −2677 | −5343 | −4730 | 456 | −4679 | −3508 | 3189 | −4377 | 700 | 2370 | −4333 | −4493 | −3784 | −4113 | −3814 | −2898 | −388 | −2995 | 638 | 538 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 475 | 209 | −2876 | 1227 | 291 | −3197 | −933 | 379 | −2948 | 534 | −1202 | −1966 | 1659 | −2471 | 168 | 208 | 398 | −1343 | −2498 | −3060 | 1803 | 539 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 476 | −1404 | −2876 | 321 | 1444 | −3197 | −2378 | −1036 | −2948 | 168 | −2892 | 959 | 454 | −2471 | 1163 | 1263 | 972 | 28 | −2498 | −3060 | 1162 | 540 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 477 | 3146 | 1780 | −5333 | −5642 | −5273 | 138 | −4626 | −5084 | −5281 | −5350 | −4384 | −3712 | −3695 | −4723 | −4902 | 1148 | −2464 | −3791 | −5502 | −5475 | 541 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 478 | −4523 | −3907 | −6924 | −6340 | −2047 | −6727 | −5392 | −203 | −6149 | 3019 | 2126 | −6452 | −5729 | −4893 | −5624 | −6108 | −4365 | −66 | −3885 | −4119 | 542 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −4 | -8959 | −10001 | -894 | −1115 | −701 | −1378 | * | * | | | | | | | | | | | | |
| 479 | −133 | −2849 | −1274 | 579 | −3156 | −2395 | −1059 | −113 | 1266 | −2861 | −1946 | 1695 | −2490 | −605 | −1149 | 775 | 1943 | −2464 | −3045 | −2373 | 543 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 480 | −2144 | −1946 | −4419 | −3792 | -88 | −3720 | −2577 | −1077 | −3411 | 318 | 4544 | −3345 | −3703 | 315 | −3218 | −2814 | 60 | 308 | −2348 | −2061 | 544 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | -8959 | −10001 | -894 | −1115 | −701 | −1378 | * | * | | | | | | | | | | | | |
| 481 | −2322 | −3171 | 1166 | −2407 | −5061 | −2965 | −3158 | −4889 | −3321 | −4974 | −4125 | −2481 | 2189 | −2882 | −3821 | 2590 | 1331 | −3957 | −5155 | −4587 | 545 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 482 | −578 | −2867 | 1016 | 2165 | −304 | −2419 | −1094 | −2893 | 992 | 435 | −1965 | −1064 | 1054 | −645 | −1198 | −1344 | −1395 | −2474 | −3066 | −2397 | 546 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 483 | 250 | −2985 | 1077 | 2695 | −628 | −267 | −1135 | −3051 | 803 | −2999 | −2080 | −1077 | −2558 | −681 | −1251 | −1387 | −411 | −2604 | −3171 | −2483 | 547 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 484 | −269 | −3283 | −1808 | 2886 | −3682 | −2830 | −1354 | −3365 | 1786 | −1638 | −2380 | −1469 | −2904 | 53 | 453 | −1801 | −1830 | −2952 | −3357 | −2793 | 548 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 485 | −3531 | 1467 | −4180 | −2861 | −5129 | −361 | −2026 | −4452 | 2201 | −4111 | −3424 | −2778 | −4046 | 693 | 3270 | −3409 | −3231 | −4207 | −3964 | −3845 | 549 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 486 | 482 | −2886 | −1265 | 1183 | −3208 | −2390 | −1045 | −395 | 1448 | −2900 | −1975 | 92 | −2482 | 2060 | 1423 | −60 | −1355 | −2508 | −3067 | −2387 | 550 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 487 | −660 | −2861 | −1259 | 909 | −778 | −1061 | −1041 | −2920 | 1604 | 99 | 1593 | 456 | −417 | 164 | 1336 | −138 | −1344 | −2479 | −3048 | −2370 | 551 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 488 | −2812 | −3649 | −3151 | −2252 | −4095 | −3624 | −1819 | −101 | −9 | 234 | −2780 | 1510 | −3622 | 300 | 3320 | −2756 | −2627 | −3354 | −3592 | −3292 | 552 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 489 | −1588 | −2127 | −2027 | 763 | 1713 | −2765 | 3285 | −1776 | −1356 | −2015 | 1992 | 218 | −2845 | −1260 | −1731 | −97 | −1527 | −1607 | 3276 | −1739 | 553 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 490 | −228 | −2885 | −1261 | 1396 | −3207 | −353 | −1044 | −2957 | 1533 | −2900 | −1975 | −1023 | −2480 | 850 | 1711 | 823 | 29 | −2508 | −3067 | −2386 | 554 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 491 | −232 | −2887 | −1266 | 856 | −3209 | −285 | 1332 | −2957 | 2542 | −2902 | −1977 | −1026 | −2484 | −588 | 317 | 583 | 29 | −2510 | −3068 | −2389 | 555 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 492 | −1742 | −1748 | −3165 | −2664 | −1655 | −3123 | 2320 | −1268 | −2335 | 2042 | 3095 | 383 | −3217 | −2180 | −2391 | −264 | −1696 | −1188 | −2149 | −1743 | 556 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 493 | −1581 | 1408 | −1091 | −2782 | 2171 | −3060 | 1464 | −1014 | −51 | −305 | 1835 | −2515 | −3116 | −2205 | −12 | −2119 | −1522 | −927 | 2847 | 2340 | 557 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 494 | −132 | −2876 | 832 | −707 | −3196 | −2381 | 1777 | −2946 | 2609 | −2892 | 286 | 365 | −2474 | −580 | 270 | 7 | −456 | −2498 | −3060 | −2379 | 558 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 495 | −131 | −2820 | -87 | 303 | −3116 | −2392 | 1329 | −2849 | −643 | −925 | −1916 | −1037 | −2484 | 2170 | 364 | −331 | −1347 | −435 | −3019 | 2762 | 559 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 496 | −376 | −2786 | −5960 | −5625 | −3437 | −5761 | −5662 | 2937 | −5568 | −516 | −2151 | −5419 | −5519 | −5494 | −5706 | −5114 | −3275 | 2642 | −5094 | −4595 | 560 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 497 | −1477 | −2099 | −1860 | −458 | −2169 | −2641 | −1358 | 389 | 627 | 967 | −1262 | −376 | −15 | −1094 | −1578 | 1490 | 1153 | −139 | −2456 | −1971 | 561 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | -89 | -8959 | −4120 | -894 | −1115 | −701 | −1378 | * | * | | | | | | | | | | | | |
| 498 | −119 | −2839 | −1219 | 759 | −3163 | −2344 | −998 | −2910 | 2043 | −2854 | −1930 | 209 | −2437 | −540 | 1024 | 463 | 1681 | −2463 | −3019 | −2342 | 562 |
| — | −149 | −500 | 233 | 43 | −381 | 399 | 106 | −626 | 210 | −466 | −720 | 275 | 394 | 45 | 96 | 359 | 117 | −369 | −294 | −249 | |
| T | −5 | -8875 | −9917 | -894 | −1115 | −1319 | −739 | * | * | | | | | | | | | | | | |
| 499 | −2872 | −3842 | −2701 | −2108 | −3054 | −3571 | 4240 | −3893 | -861 | −3684 | −2989 | 1048 | −3628 | 734 | 679 | −2747 | −2710 | −3613 | −3125 | 2722 | 563 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | -8875 | −9917 | -894 | −1115 | −416 | −1996 | * | * | | | | | | | | | | | | |
| 500 | −2964 | −4295 | 3033 | −1635 | −5349 | −3128 | −2754 | −5257 | −3044 | −5197 | −4490 | 19 | −3722 | −2445 | −3852 | 372 | 2615 | −4548 | −5391 | −4478 | 564 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 501 | 850 | −1950 | −4542 | −3976 | −2096 | −3820 | −2884 | 1642 | −3633 | −1721 | 1270 | −3507 | −3877 | −3303 | −3495 | 1712 | −2136 | 2168 | −2747 | −2389 | 565 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 502 | 1190 | −2893 | 754 | −730 | −3210 | 151 | −1072 | −2957 | −661 | −2910 | −1990 | 368 | −2501 | 2665 | −1169 | 239 | −188 | −2514 | −3085 | 629 | 566 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 503 | −1406 | −2859 | 224 | −44 | 964 | −2382 | 2312 | −2917 | −625 | −2872 | −1950 | 791 | −2475 | 1416 | 928 | 542 | −1345 | −923 | −3047 | 1912 | 567 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 504 | −7105 | −5660 | −6607 | −6980 | −5351 | −5674 | −5723 | −7746 | −7072 | −7049 | −7086 | −6845 | −6098 | −6903 | −6523 | −7533 | −7247 | −7591 | 6305 | −5006 | 568 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 505 | 2121 | 1495 | −3613 | −3109 | −2193 | 1111 | −2414 | 1685 | −2847 | −2081 | −1408 | −2743 | −3282 | 311 | −2892 | −2124 | 958 | −1563 | −2649 | −2296 | 569 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 506 | −1407 | −2877 | −1256 | 1660 | −3197 | −2381 | −1039 | −2947 | 843 | −2892 | −1966 | 1685 | −2474 | 1057 | 1363 | −61 | −182 | −458 | −3060 | 531 | 570 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 507 | −602 | 1178 | 138 | 371 | −3197 | −2380 | 1196 | −2947 | 1303 | −2893 | −1967 | 438 | −2474 | −581 | −1129 | 1837 | 1200 | −2499 | −3061 | −2379 | 571 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 508 | −2039 | 1144 | −4191 | −3620 | 3634 | −3526 | −2039 | −1352 | −3230 | 871 | −1043 | −3067 | −3568 | 478 | −3046 | −696 | −1979 | −1289 | −1735 | 526 | 572 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 509 | −1607 | −1438 | −732 | −3281 | 1196 | −3153 | −2022 | 1874 | −2885 | 1356 | 721 | −2786 | −3201 | 206 | −2699 | -890 | −1547 | 1530 | −1897 | −1555 | 573 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | -86 | -8959 | −4166 | -894 | −1115 | −701 | −1378 | * | * | | | | | | | | | | | | |
| 510 | −636 | −2822 | 356 | 137 | −3143 | −2322 | 486 | −2894 | 443 | −2838 | −1911 | 1178 | −2415 | 1950 | 1064 | 1584 | −435 | −2444 | −3005 | −2322 | 574 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −5 | -8878 | −9920 | -894 | −1115 | −422 | −1979 | * | * | | | | | | | | | | | | |
| 511 | −1606 | −3066 | 2566 | 1977 | −3365 | −2501 | −1219 | −3116 | -837 | −930 | −2167 | −1136 | −2635 | −772 | 277 | 604 | −1551 | −2680 | −3253 | 129 | 575 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 512 | 1061 | −3281 | −6068 | −5476 | 677 | −5538 | −4342 | 1298 | −5179 | 2630 | -831 | −5220 | −5107 | −4359 | −4837 | −4740 | −3591 | −1795 | −3471 | −3431 | 576 |
| — | −149 | −500 | 233 | 43 | −381 | 399 | 106 | −626 | 210 | −466 | −720 | 275 | 394 | 45 | 96 | 359 | 117 | −369 | −294 | −249 | |
| H | −4 | -8959 | −10001 | -894 | −1115 | −701 | −1378 | * | * | | | | | | | | | | | | |
| 513 | 519 | −2869 | −1255 | 1249 | −3186 | −2380 | 797 | −2934 | 1531 | -868 | −1959 | 1081 | −2473 | 393 | −1127 | −594 | 749 | −2489 | −3054 | 1412 | 577 |
| — | −149 | −500 | 233 | 43 | −381 | 399 | 106 | −626 | 210 | −466 | −720 | 275 | 394 | 45 | 96 | 359 | 117 | −369 | −294 | −249 | |
| C | −4 | -8959 | −10001 | -894 | −1115 | −701 | −1378 | * | * | | | | | | | | | | | | |
| 514 | 926 | −2877 | 1061 | 858 | −3198 | −2380 | −1038 | −692 | 359 | −2893 | −1967 | 992 | −2473 | 647 | 1930 | −1287 | −1345 | −2499 | −3061 | 531 | 578 |
| — | * | * | * | * | * | * | * | * | * | * | * | * | * | * | * | * | * | * | * | * | |
| S | * | * | * | * | * | * | * | * | 0 | | | | | | | | | | | | |
| // | | | | | | | | | | | | | | | | | | | | | |

HMMER2.0 [2.3.2]
NAME Trehalose_PPase
ACC PF02358.8
DESC Trehalose-phosphatase
LENG 251
ALPH Amino
RF no
CS no
MAP yes
COM hmmbuild -F HMM_ls.ann SEED.ann
COM hmmcalibrate --seed 0 HMM_ls.ann
NSEQ 24
DATE Thu Jun 26 16:41:21 2008
CKSUM 7747
GA −49.4000 −49.4000;
TC −48.9000 −48.9000;
NC −49.9000 −49.9000;
XT −8455 −4 −1000 −1000 −8455 −4 −8455 −4
NULT −4 −8455
NULE 595 −1558 85 338 −294 453 −1158 197 249 902 −1085 −142 −21 −313 45 531 201 384 −1998 −644
EVD −147.909348 0.162078

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | −70 | * | −4393 | | | | | | | | | | | | | | | | | | |
| 1 | −2140 | 1327 | −4484 | −3849 | 3068 | −3695 | −2564 | 239 | −3447 | 1159 | 2286 | −3341 | −479 | −142 | −3244 | −2782 | −2079 | 103 | −2407 | −2077 | 1 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | −70 | * | | | | | | | | | | | | |
| 2 | −438 | −1920 | −4415 | −568 | 2013 | −3645 | −2515 | −1349 | −3385 | 2153 | 1899 | −3283 | −3687 | −3005 | −3192 | −2730 | 44 | 456 | −2373 | −2038 | 2 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 3 | −4124 | −6144 | 3996 | −283 | −5790 | −3813 | −3270 | −6309 | −3762 | −6106 | −5606 | −2405 | −4415 | −2996 | −4801 | −3716 | −4236 | −5752 | −5983 | 778 | 3 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 4 | −776 | −2648 | −5022 | −4510 | 1875 | −4337 | −2551 | 1253 | −4108 | −616 | −1816 | −290 | −4360 | −3623 | −3870 | −3441 | −2817 | −2055 | −2111 | 3979 | 4 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −59 | −9479 | −4702 | −894 | −1115 | −701 | −1378 | * | * | | | | | | | | | | | | |
| 5 | −3856 | −5872 | 3808 | 205 | −6005 | −3659 | −3059 | −5966 | −231 | −5801 | −5195 | −2240 | −308 | 340 | −4272 | −3476 | −3939 | −5420 | −5994 | −4911 | 5 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9423 | −10465 | −894 | −1115 | −424 | −1974 | * | * | | | | | | | | | | | | |
| 6 | −432 | −3354 | −4002 | −4018 | −5608 | 3495 | −4002 | −5358 | −3563 | −5459 | −4585 | −3584 | −4182 | −27 | −344 | −417 | −3057 | −4331 | −5564 | −5314 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 7 | −2520 | −3134 | −5531 | −5881 | −5842 | 236 | −5112 | −5673 | −5746 | −5929 | −4959 | −4187 | −4219 | −5188 | −5409 | 472 | 3771 | −4348 | −6055 | −6023 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 8 | −3572 | −3348 | −5680 | −4780 | −2488 | −5081 | −3646 | 1010 | 586 | 2663 | 1656 | −4480 | −4902 | −3633 | 528 | −4255 | −3457 | −2357 | −3568 | −3433 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 9 | 237 | −1955 | −3556 | −2963 | −1927 | −3419 | −2244 | 1 | 498 | 20 | 744 | −2789 | −3478 | −2461 | −421 | 1893 | 1431 | 706 | −2397 | −2031 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 10 | −1869 | −3350 | 1514 | 1185 | −3668 | −798 | 966 | −3422 | −1086 | −3365 | −2441 | 1002 | 2409 | 262 | 35 | −1744 | 72 | −2971 | −3532 | −2844 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 11 | −1936 | −2137 | 363 | 2 | −2136 | −3264 | −2040 | 2807 | −2173 | 450 | 977 | −2388 | −517 | −64 | −2417 | −495 | −1876 | −1577 | 1926 | −2149 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 12 | 1119 | −2839 | −345 | −1360 | 911 | 257 | −1581 | −2649 | 60 | −2787 | −1976 | −1627 | −2983 | 931 | −1725 | −681 | −471 | 2220 | −3130 | −2561 | 12 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 13 | −270 | −3249 | 339 | 1402 | −3565 | −2765 | −1424 | 794 | 605 | −3263 | −2340 | −1402 | 1253 | −966 | 683 | 983 | −366 | −563 | −3436 | −2756 | 13 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −212 | −9479 | −2888 | −894 | −1115 | −701 | −1378 | * | * | | | | | | | | | | | | |
| 14 | −1638 | −3110 | 2129 | 8 | 1018 | −2609 | 1164 | −3181 | 143 | −3126 | −2200 | 351 | −2704 | 827 | 1336 | −1518 | 1263 | −2732 | −3293 | −2611 | 14 |
| — | −149 | −500 | 233 | 43 | −381 | 398 | 106 | −626 | 210 | −466 | −721 | 275 | 394 | 45 | 96 | 359 | 117 | −369 | −294 | −243 | |
| — | −100 | −3913 | −10313 | −144 | −3395 | −2198 | −355 | * | * | | | | | | | | | | | | |
| 15 | −2630 | −4183 | −1487 | 652 | −4497 | −3170 | 1464 | −4271 | 92 | −4182 | −3334 | 384 | 3520 | −1678 | −2279 | −305 | −2601 | −3814 | −4336 | −3600 | 16 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9270 | −10313 | −894 | −1115 | −211 | −2875 | * | * | | | | | | | | | | | | |
| 16 | −530 | −3117 | 2210 | 644 | −3369 | −2813 | −1483 | 1729 | −1097 | −1286 | 1437 | 995 | −48 | 309 | −1592 | −1730 | −1755 | −2701 | −3342 | −2702 | 17 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 17 | 1624 | 776 | 1026 | 177 | −3555 | −2766 | −1426 | −3300 | 533 | −3255 | 948 | −1405 | −2859 | 507 | 523 | 611 | −1729 | 628 | −3431 | −2753 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 18 | 2409 | −2131 | −2940 | 447 | −2130 | −3269 | −2047 | 519 | 175 | −792 | 1220 | −2399 | −3337 | −188 | −2425 | −2276 | −347 | 528 | −2549 | −2147 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 19 | 344 | −2330 | 171 | −345 | 676 | −3129 | −1868 | 444 | −1801 | −2218 | −1504 | −147 | 671 | −1691 | 853 | −2104 | 1059 | 1359 | 994 | 127 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 20 | −2459 | −2250 | −4814 | −4201 | −2140 | −4068 | −2981 | −68 | −3820 | 684 | 1595 | −3718 | 3049 | −3433 | −3632 | −358 | −2403 | 1519 | −2797 | −2473 | 21 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 21 | −797 | −2679 | 65 | −1553 | −2814 | −2974 | 1579 | −2433 | −1449 | −646 | −1854 | −1787 | 1154 | −1376 | −1883 | 1974 | 1704 | 23 | −3029 | −2506 | 22 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 22 | 23 | −3266 | 2027 | −31 | −3587 | −2765 | 670 | −3338 | 9 | −3282 | −2355 | −128 | 1524 | 1381 | 524 | 738 | −1732 | −2888 | −3449 | −2766 | 23 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 23 | 103 | −3301 | −252 | 1964 | −3621 | 284 | −1453 | −3373 | 557 | −3316 | −2391 | 248 | −2885 | −994 | 2146 | 216 | −1765 | −2923 | −3483 | −2799 | 24 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 24 | 320 | −2430 | −5073 | −4476 | −2361 | −4360 | −3300 | 1361 | −4113 | 1535 | 3281 | −4008 | −4350 | −3732 | −3933 | −3474 | 651 | 874 | −3089 | −2764 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 25 | −614 | −1910 | −3809 | −3203 | −1875 | −3470 | −2309 | 1729 | 934 | 1292 | −1109 | −2931 | 560 | −2619 | 1434 | −2530 | −569 | −333 | −2358 | 343 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 26 | −489 | −3280 | 1589 | 1324 | −3601 | 63 | −1436 | −3352 | −1019 | −3296 | −2370 | 419 | −2869 | 507 | 1104 | 1445 | −264 | −2902 | −3464 | −2780 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 27 | 1002 | −1934 | −3661 | −3064 | −1902 | −599 | −2272 | 1406 | −2788 | 968 | −1132 | −241 | −479 | 30 | −2818 | −621 | 983 | 935 | −2378 | −2016 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 28 | −4933 | −4368 | −7319 | −6848 | −2656 | −6944 | −5947 | −1861 | −6662 | 3175 | −1437 | −6857 | −6209 | −5493 | −6178 | −6436 | −4831 | 784 | −4480 | −4641 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 29 | −539 | −3266 | −110 | −1093 | −3587 | −2767 | 854 | −301 | 1748 | −3281 | −2355 | 1994 | −2860 | 1988 | 1175 | −319 | −1733 | −2888 | −3448 | −2766 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 30 | 762 | −3254 | 1195 | 39 | −3572 | −2763 | 853 | −3320 | 1157 | −1012 | 1025 | 680 | −2857 | −963 | 1567 | −1670 | 435 | −778 | −3439 | −2758 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 31 | −5136 | −4492 | −7524 | −6936 | −2514 | −7360 | −5975 | −1937 | −6750 | 3164 | 1158 | −7112 | −6271 | −5412 | −6180 | −6781 | −4965 | 221 | −4381 | −4641 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 32 | 2513 | 3637 | −5874 | −6184 | −5779 | −230 | −5141 | −5590 | −5804 | −5856 | −4890 | −4225 | −4203 | −5241 | −5417 | 1259 | 899 | −4297 | −6009 | −5985 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 33 | 1129 | −3393 | −235 | −249 | −3713 | −2839 | −1534 | −3467 | 1126 | −3411 | −2490 | 780 | −2957 | −1079 | −1650 | 2307 | 406 | −3016 | −3579 | −2889 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 34 | −370 | 807 | 2715 | −1095 | −3565 | −2767 | 447 | −299 | 1120 | −3263 | −2341 | 814 | −2860 | 286 | 672 | −1674 | −1730 | −2869 | −3436 | 1 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −70 | −9479 | −4434 | −894 | −1115 | −701 | −1378 | * | * | | | | | | | | | | | | |
| 35 | −2032 | 2972 | −4267 | −3662 | 1367 | −578 | −2421 | −1429 | −3285 | 98 | −1134 | −3172 | 2786 | −2925 | −3126 | 354 | −1991 | −1344 | −2297 | 811 | 36 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9411 | −10454 | −894 | −1115 | −392 | −2072 | * | * | | | | | | | | | | | | |
| 36 | −1838 | −3311 | 22 | −1122 | −3633 | 126 | 801 | −3383 | 1438 | −3325 | −2401 | 1596 | 1730 | −1003 | 1691 | 128 | −1777 | −2934 | −3491 | −2809 | 37 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −535 | −9479 | −1696 | −894 | −1115 | −701 | −1378 | * | * | | | | | | | | | | | | |
| 37 | −2066 | −2660 | −3310 | −3399 | −4245 | 1448 | −3490 | 1167 | −3669 | −4147 | −3393 | 3425 | −3611 | −3386 | −3831 | −2291 | 983 | −3131 | −4557 | −4209 | 38 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | −8948 | −9990 | −894 | −1115 | −1938 | −436 | * | * | | | | | | | | | | | | |
| 38 | 1426 | −1707 | −4035 | −3427 | −1713 | −3437 | −2334 | 1054 | −3077 | −404 | −922 | −3020 | −3482 | 1170 | −2961 | −2524 | 1971 | 1574 | −2256 | −1906 | 39 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | −9057 | −10099 | −894 | −1115 | −131 | −3528 | * | * | | | | | | | | | | | | |
| 39 | −3081 | −2755 | −5552 | −5018 | −2886 | −4955 | −4031 | 1713 | −4717 | 992 | −1899 | −4603 | −4897 | −4389 | −4591 | −4112 | 834 | 2595 | −3775 | 1403 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 40 | 2198 | −2170 | −4649 | −4056 | 1257 | −3889 | −2504 | 19 | −3653 | −1968 | −1367 | −3481 | −3929 | −3239 | −3440 | −2981 | −2306 | 1399 | 3509 | 1495 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 41 | −4388 | −3868 | −6886 | −6379 | 469 | −6590 | −5608 | 3047 | −6194 | 1327 | 1101 | −6273 | −5987 | −5345 | −5894 | −5897 | −4300 | 1362 | −4469 | −4516 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 42 | −2288 | −2084 | −4649 | −4032 | 491 | −3892 | −2796 | 2255 | −3647 | 923 | −1279 | −86 | −3926 | −3280 | −3462 | 360 | −2232 | 2081 | −2646 | −2300 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 43 | −2584 | −3193 | −5527 | −5874 | −5845 | −3460 | −5130 | −5709 | −5730 | −5962 | −5009 | −4233 | −4270 | −5211 | −5408 | 3441 | 1609 | −4402 | −6040 | −5997 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 44 | −180 | −3316 | −5562 | −5906 | 1164 | 3558 | −4947 | −5613 | −5826 | −5782 | −4975 | −4334 | −4390 | −5269 | −5497 | −2987 | −3205 | −4462 | −5347 | −4758 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 45 | −3270 | −4151 | −3646 | −2760 | −4767 | −4059 | −2336 | −4271 | −13 | −735 | −3393 | −2819 | −156 | −1923 | 3666 | 78 | −261 | −3977 | −4171 | −3878 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 46 | −2120 | 871 | 2061 | −149 | −3940 | 851 | −1730 | −3701 | 721 | −3644 | −2735 | −1604 | 26 | −1285 | −1900 | 2085 | −2074 | −3244 | −3815 | −3110 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 47 | −1954 | 1551 | −3165 | −2586 | −2045 | −3330 | −2124 | 428 | 147 | 857 | 1041 | −13 | −236 | 1811 | 1581 | −2352 | −1894 | 758 | −2485 | −2099 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 48 | 1056 | −3257 | 967 | 1246 | −3576 | −2763 | −1422 | −484 | 675 | −3272 | −2346 | −1399 | −2856 | 1226 | 773 | −477 | −128 | 600 | −3441 | −2760 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 49 | −567 | −3115 | 1297 | 1252 | 2020 | −2800 | −1466 | −3081 | 902 | −1014 | −2221 | −1463 | −536 | −1029 | −1570 | −29 | −337 | −731 | −3337 | 1118 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2001 | −9479 | −417 | −894 | −1115 | −701 | −1378 | * | * | | | | | | | | | | | | |
| 50 | −3442 | −2950 | −4783 | −4700 | −1462 | −4258 | −3722 | −1007 | −4386 | 3221 | −434 | −4546 | −4247 | −3835 | −4064 | −4342 | −3434 | −1668 | −2849 | −2749 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −378 | −7490 | −2151 | −894 | −1115 | −4179 | −82 | * | * | | | | | | | | | | | | |
| 51 | −527 | −1805 | 1364 | 180 | −2056 | −1450 | −166 | 831 | 220 | −1791 | −932 | 1573 | −1581 | 256 | 1388 | −438 | −472 | −1386 | −2033 | −1397 | 52 |
| — | −149 | −500 | 232 | 42 | −378 | 398 | 105 | −624 | 210 | −465 | −714 | 275 | 393 | 45 | 95 | 359 | 120 | −368 | −295 | −250 | |
| — | −2291 | −2385 | −727 | −2605 | −259 | −1967 | −426 | * | * | | | | | | | | | | | | |
| 52 | −2207 | −1984 | −3847 | −3267 | −757 | −3786 | −2505 | −273 | −2747 | 2477 | 2763 | −3174 | −3530 | 1478 | −2686 | −2931 | −2110 | −832 | −2099 | −1986 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −12 | −7521 | −8563 | −894 | −1115 | −151 | −3331 | * | * | | | | | | | | | | | | |
| 53 | 829 | −2899 | −1757 | 1770 | −3100 | −2791 | −1469 | −2771 | 7 | 274 | −2024 | 81 | −2882 | −1062 | −1593 | 496 | −279 | 1428 | −3162 | −2562 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9401 | −10443 | −894 | −1115 | −366 | −2156 | * | * | | | | | | | | | | | | |
| 54 | −1789 | 1327 | 1732 | 884 | −3557 | −2766 | −1425 | −1033 | −66 | −854 | −2335 | 759 | −2859 | 667 | 517 | −319 | −539 | −2862 | 2880 | 906 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 55 | 262 | −3252 | 124 | 446 | −3568 | −2764 | −1423 | −3316 | 447 | 723 | 1463 | 699 | −2857 | 897 | 218 | −532 | −1728 | −2871 | 3480 | −2757 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 56 | −1945 | −2086 | −478 | −2489 | 2296 | 50 | −2090 | −1633 | −111 | 956 | 1935 | −224 | −3368 | −2120 | 734 | −2317 | −1885 | −289 | −2509 | 1349 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −121 | −9479 | −3667 | −894 | −1115 | −701 | −1378 | * | * | | | | | | | | | | | | |
| 57 | 235 | −2306 | −379 | −1749 | 2207 | 234 | −1733 | −540 | −1619 | −2201 | −1477 | 167 | −3079 | 620 | −1987 | 674 | −1739 | 1701 | −2682 | −2221 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9362 | −10404 | −894 | −1115 | −299 | −2419 | * | * | | | | | | | | | | | | |
| 58 | −1790 | −3263 | 626 | −1088 | 116 | 1473 | 782 | −3334 | 1642 | −3279 | −2352 | −27 | 168 | 252 | 907 | 610 | −1729 | −2885 | −3446 | −2763 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 59 | −2621 | 2828 | −5004 | 122 | −2468 | −4323 | −3293 | 1249 | −4070 | 624 | −1600 | −3963 | 1719 | −3731 | −3917 | −3439 | −2572 | 2192 | −3130 | −2775 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 60 | −485 | −3253 | 474 | 307 | 667 | −2764 | −1423 | −3319 | 760 | −1055 | −2343 | −28 | 2187 | 474 | −1511 | 227 | −345 | −2873 | −3439 | 1140 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 61 | −509 | −3380 | 992 | 1803 | −3698 | 1203 | −1517 | −3452 | 271 | −3394 | −2473 | 2132 | −2943 | 329 | 69 | −1770 | −1839 | −3001 | −3562 | −2872 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 62 | −491 | −4065 | −6924 | −6315 | 1663 | −6493 | −5217 | 2044 | −6045 | 2449 | 934 | −6184 | −5846 | −5040 | −5621 | −5737 | −4421 | −2570 | −4104 | −4203 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 63 | −2402 | −2560 | −3201 | −212 | −2107 | 2518 | −2397 | −2191 | −2793 | −2476 | −1829 | −2834 | 1250 | −2600 | −2976 | −2735 | −2380 | −58 | 3581 | 1659 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 64 | −3197 | −2894 | −5609 | −5031 | −2512 | −4964 | −3901 | 1804 | −4696 | 2219 | −1511 | −4614 | −4857 | −4235 | −4498 | −4104 | −389 | 167 | −3522 | 2642 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 65 | 2395 | −2078 | −4516 | −3948 | 420 | −881 | −2759 | 770 | −3572 | −2046 | −1409 | −3381 | −3760 | −3208 | −3403 | 1514 | −2159 | 859 | −2682 | −2341 | 73 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 66 | 2816 | −3122 | −5655 | −6008 | −5846 | 2494 | −5141 | −5675 | −5804 | −5934 | −4959 | −4205 | −4213 | −5228 | −5436 | −403 | −2991 | −4341 | −6062 | −6042 | 74 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 67 | −2493 | −3573 | −1890 | 3040 | −3911 | −3256 | −2254 | −3547 | −2041 | −224 | −2905 | 367 | −3530 | −1892 | −2543 | 1389 | −2501 | −429 | −4023 | −3401 | 75 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 68 | −4985 | −5441 | −3662 | −4015 | −4757 | −4920 | 5051 | −6871 | −4741 | −6507 | −6149 | 2326 | −5470 | −4577 | −4987 | −4920 | −5209 | −6329 | −5040 | −4257 | 76 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 69 | −6706 | −5971 | −6982 | −7366 | −7600 | 3860 | −6711 | −8550 | −7592 | −8009 | −7846 | −7163 | −6477 | −7420 | −7070 | −7077 | −7029 | −7946 | −6398 | −7600 | 77 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 70 | 1704 | 2777 | −4347 | −3714 | 1142 | −3563 | −2428 | −1341 | −3313 | −339 | 2784 | −3204 | −3615 | −2938 | −3119 | 165 | −1962 | −1264 | −2293 | 1905 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 71 | −525 | 1488 | 951 | 2016 | 3054 | −3439 | −2160 | −2717 | −2244 | −2921 | −2233 | −2295 | −3607 | −2069 | −2651 | −2542 | −2406 | −2542 | −2906 | 1426 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 72 | −2003 | −1832 | −4325 | −3690 | −1786 | −3548 | 1093 | 2240 | −3290 | 642 | 908 | −3186 | −3598 | −2918 | 625 | −1029 | 285 | 1476 | −2290 | 731 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 73 | −1937 | −2900 | −2049 | −316 | −3064 | −2995 | −1652 | −138 | 518 | −2837 | 524 | −1735 | −3077 | −1280 | 3302 | −386 | 98 | −654 | −3177 | −2632 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 74 | 338 | −2583 | 1101 | −1593 | −2674 | −72 | 715 | 752 | −186 | −179 | 688 | 15 | 509 | −1401 | −1898 | 335 | −1800 | −340 | 2663 | −2418 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 75 | −494 | −3027 | 96 | −1276 | −3252 | −2863 | −1556 | −355 | −231 | −3009 | −2161 | 2218 | 2777 | −1144 | −1681 | −1796 | 402 | −638 | −3294 | −2684 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 76 | 105 | −3261 | 1502 | −133 | −3582 | 1254 | 782 | −3333 | −139 | −1079 | −2350 | 873 | 25 | 309 | −95 | 537 | −365 | −2883 | −3444 | −2761 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 77 | −422 | 960 | −1757 | −1213 | −3528 | 2143 | −1524 | −3252 | 1212 | −3247 | −2347 | 1332 | −2930 | 237 | −1616 | 991 | −1788 | −536 | −3453 | −2799 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −209 | −9479 | −2906 | −894 | −1115 | −701 | −1378 | * | * | | | | | | | | | | | | |
| 78 | −1632 | −3104 | 587 | 1330 | −3425 | 916 | −1265 | −3175 | 314 | −3120 | −2193 | −1242 | −2699 | 506 | 118 | 664 | 1219 | −2726 | 1901 | 699 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9273 | −10315 | −894 | −1115 | −1248 | −788 | * | * | | | | | | | | | | | | |
| 79 | −1683 | −3153 | 1540 | −122 | −3472 | −2657 | 1963 | −3222 | 351 | −3168 | 746 | 826 | −428 | 742 | −1404 | 744 | 656 | −566 | 2354 | −2655 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9341 | −10383 | −894 | −1115 | −272 | −2539 | * | * | | | | | | | | | | | | |
| 80 | −216 | −3157 | −1726 | 128 | −3427 | −2815 | 2750 | −3139 | −72 | −1297 | 1434 | −1473 | −2906 | 371 | 214 | −552 | −1759 | −2752 | 4599 | −2724 | 88 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 81 | −1803 | −3088 | −1730 | 1066 | 178 | −431 | −1475 | 371 | 19 | −3072 | −2197 | 650 | −2899 | 1613 | −1582 | −350 | 1400 | −670 | −3317 | 1699 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −246 | −9479 | −2688 | −894 | −1115 | −701 | −1378 | * | * | | | | | | | | | | | | |
| 82 | −1736 | −2472 | −2078 | −1541 | −2667 | −222 | 834 | −2280 | −1432 | −2490 | 1331 | 2706 | −2974 | −1354 | −1849 | 640 | 1890 | −125 | −2907 | −2401 | 90 |
| — | −150 | −501 | 231 | 43 | −382 | 397 | 108 | −628 | 211 | −467 | −722 | 274 | 395 | 44 | 96 | 362 | 117 | −364 | −296 | −247 | |
| — | −4401 | −3189 | −246 | −2488 | −283 | −967 | −1034 | * | * | | | | | | | | | | | | |
| 83 | −993 | −2427 | −97 | 2130 | −2791 | 888 | −461 | −2526 | 1919 | −2451 | −1605 | −271 | −1868 | −45 | −436 | −832 | −952 | −2095 | −2595 | −1931 | 100 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −15 | −7191 | −8233 | −894 | −1115 | −4259 | −77 | * | * | | | | | | | | | | | | |
| 84 | −1448 | −2899 | 32 | 2032 | −3208 | −1763 | −792 | −3020 | −456 | −2921 | −2171 | −413 | −2133 | 3341 | −875 | −1232 | −1440 | −2599 | −3029 | −2332 | 101 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −15 | −7191 | −8233 | −894 | −1115 | −4259 | −77 | * | * | | | | | | | | | | | | |
| 85 | −600 | −1497 | 1370 | −163 | −1837 | 806 | −504 | 1596 | −297 | −1645 | −866 | −405 | −1755 | −168 | −764 | 982 | −613 | −1155 | −2020 | −1460 | 102 |
| — | −147 | −500 | 233 | 43 | −381 | 398 | 105 | −627 | 211 | −466 | −721 | 277 | 393 | 45 | 96 | 360 | 117 | −370 | −295 | −250 | |
| — | −2355 | −320 | −8233 | −56 | −4723 | −4259 | −77 | * | * | | | | | | | | | | | | |
| 86 | −1225 | −2874 | 1754 | 2546 | −3136 | −1592 | −653 | −2949 | 1423 | −2860 | −2042 | −197 | −1957 | −262 | −1128 | −994 | −1221 | −2476 | −3034 | −2219 | 104 |
| — | −149 | −500 | 233 | 43 | −381 | 398 | 105 | −627 | 210 | −464 | −721 | 275 | 393 | 45 | 97 | 360 | 117 | −368 | −295 | −250 | |
| — | −2355 | −320 | −8233 | −56 | −4723 | −4259 | −77 | * | * | | | | | | | | | | | | |
| 87 | −612 | −574 | −2213 | −1638 | −343 | −2050 | −820 | 22 | −1330 | 858 | 280 | 1251 | −2109 | −1106 | −1372 | −1113 | −556 | 1296 | 3597 | −406 | 106 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −15 | −7191 | −8233 | −894 | −1115 | −4259 | −77 | * | * | | | | | | | | | | | | |
| 88 | −1657 | −1964 | −2208 | −1585 | −1553 | −2586 | −1091 | −1035 | 2087 | 2229 | −594 | −1589 | −2650 | −823 | −265 | −1857 | −1558 | −1189 | −2072 | −1733 | 107 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −15 | −7191 | −8233 | −894 | −1115 | −4259 | −77 | * | * | | | | | | | | | | | | |
| 89 | −870 | 2936 | −2298 | −1911 | 2741 | −2033 | −923 | −771 | −1688 | −1040 | −478 | 2169 | −2313 | −1445 | −1766 | −1211 | −945 | −643 | −830 | 11 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −15 | −7191 | −8233 | −894 | −1115 | −763 | −1283 | * | * | | | | | | | | | | | | |
| 90 | −162 | 2293 | 597 | −874 | −2663 | −2438 | −1117 | −2323 | 657 | 595 | 1887 | −1150 | −2527 | 1764 | −1248 | 919 | −1334 | −2026 | −2752 | −2165 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | −8904 | −9946 | −894 | −1115 | −3148 | −173 | * | * | | | | | | | | | | | | |
| 91 | 1804 | −2250 | −1696 | 79 | −2413 | −577 | −1298 | −2033 | −1045 | −2226 | −1451 | −1378 | 2063 | −972 | −1478 | −149 | 173 | 288 | −2626 | 378 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | −8904 | −9946 | −894 | −1115 | −1077 | −927 | * | * | | | | | | | | | | | | |
| 92 | 1547 | −2050 | −2951 | 2259 | −2095 | −3201 | −2131 | 957 | −2338 | 976 | −1273 | −2457 | −3330 | −2156 | −2539 | −642 | −1868 | −1398 | −2559 | −2170 | 111 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | −9187 | −10229 | −894 | −1115 | −547 | −1663 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 93 | 73 | −3160 | −1596 | −234 | −3462 | −299 | 2265 | −3200 | 73 | −1157 | −2254 | 248 | 303 | −919 | −129 | 98 | 915 | 1540 | −3354 | −2683 | 112 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9401 | −10443 | −894 | −1115 | −366 | −2156 | * | * | | | | | | | | | | | | |
| 94 | 1046 | −2932 | 507 | 1805 | −3122 | −2903 | −1609 | −2777 | −1282 | 914 | −2078 | −1629 | −3006 | −1220 | −1755 | −562 | 1460 | −602 | −3225 | −2642 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 95 | 473 | −3347 | 2325 | 1146 | 1656 | −836 | −1496 | −3415 | −1092 | −3361 | −2440 | 745 | −172 | 461 | −1605 | −1748 | −562 | −2967 | −3531 | −2844 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 96 | −2011 | −1839 | −343 | −3711 | 41 | −3558 | −2429 | 816 | −3309 | 1653 | 2862 | −3201 | −47 | −2933 | −3112 | −2642 | 932 | −1 | −2296 | 731 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −81 | −9479 | −4226 | −894 | −1115 | −701 | −1378 | * | * | | | | | | | | | | | | |
| 97 | 767 | −3223 | 1528 | 1165 | −3543 | −701 | −1425 | −192 | −1020 | −3247 | −2331 | −1390 | 1516 | −972 | −1527 | 1076 | 136 | −2848 | −3428 | −2750 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9401 | −10443 | −894 | −1115 | −366 | −2156 | * | * | | | | | | | | | | | | |
| 98 | −1906 | −2341 | −310 | −343 | −2377 | −873 | −1873 | 405 | −1805 | −2229 | 1993 | −2088 | −13 | 445 | −2151 | −2109 | −1846 | −645 | 5065 | −2279 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 99 | −381 | −1883 | −3990 | −3376 | 971 | −3503 | −2354 | 940 | 1785 | 960 | 2010 | −3028 | −3556 | 817 | 443 | −2571 | −1937 | −179 | −2334 | −1983 | 118 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 100 | −585 | −3261 | 1737 | 1152 | −3582 | −2762 | −1421 | −268 | 2028 | −3277 | −2350 | 211 | −2856 | 1008 | 86 | −620 | −1728 | −726 | −3444 | −2762 | 119 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 101 | −485 | −3245 | 745 | 1523 | −3559 | −2765 | −1425 | 95 | 1085 | −886 | 296 | −1403 | −2858 | 691 | 648 | 166 | 729 | −973 | −3433 | −2754 | 120 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 102 | 1441 | −2809 | −5616 | −5106 | −3104 | −5078 | −4240 | 395 | −225 | −14 | −2086 | −4722 | −5025 | −4552 | −4729 | −4252 | −3116 | 3041 | −4020 | −3638 | 121 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 103 | 1132 | 1372 | −1696 | 739 | −3417 | −2792 | −1456 | −3133 | 1332 | −1299 | 580 | 63 | −2884 | 290 | 678 | 503 | −1737 | −814 | 1751 | 40 | 122 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 104 | 956 | 775 | −39 | 1082 | −3574 | −2763 | 2122 | −3323 | 753 | −1266 | −2345 | −27 | 1168 | −963 | 788 | −1670 | −539 | −520 | −3440 | −2759 | 123 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 105 | −504 | −1933 | −3670 | 45 | 225 | −3443 | −2275 | 2409 | −637 | −385 | −1131 | −2855 | −3501 | 1309 | −2822 | −790 | −1920 | 1649 | −2379 | −2017 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 106 | −2406 | −2220 | −4637 | −324 | 2536 | −457 | −2648 | −1589 | −3650 | 1920 | 2762 | −3531 | −3960 | −3243 | −3458 | −3028 | −2343 | −1596 | −2405 | 400 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 107 | −585 | −3258 | 619 | 1394 | −3577 | −2762 | 1005 | −797 | −14 | −858 | −2347 | −29 | −2856 | 1958 | 1432 | −1669 | −216 | 78 | −3442 | −2760 | 126 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 108 | −485 | −3225 | 956 | 1732 | 121 | −2771 | 1553 | −3269 | −1018 | −582 | −2318 | −1412 | −2864 | 84 | 215 | −624 | −91 | −2838 | −3418 | 2421 | 127 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 109 | 127 | −3164 | 141 | −54 | 2010 | −2790 | −1454 | −3162 | 1381 | −3161 | −2265 | −1443 | −2883 | 681 | −1553 | −543 | −1739 | −493 | −3374 | 2766 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 110 | 396 | 1084 | −4359 | −3726 | −1816 | −3582 | −2455 | 126 | −224 | 690 | 1497 | −3222 | −3631 | −2955 | −3135 | −2667 | 2489 | 1108 | −2325 | −1982 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 111 | 800 | −3269 | −166 | 2674 | −3587 | −328 | −1433 | −265 | 915 | −3284 | −2359 | −1408 | −2867 | −975 | −149 | −1682 | −263 | −2890 | −3453 | −2772 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 112 | −42 | −3260 | 701 | −119 | −3580 | −2763 | 853 | −3330 | −1002 | −3276 | −2350 | −1399 | 55 | 509 | 2789 | 196 | 280 | −2882 | 1184 | −2762 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 113 | −2091 | −1918 | −4383 | −340 | −178 | −3629 | −2444 | 1241 | −3362 | 160 | −1105 | −3251 | −3676 | −2984 | −3173 | −2713 | 2957 | −1328 | 1575 | 1376 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 114 | 109 | −3729 | 1285 | 158 | −4036 | −3015 | −1797 | −3802 | −220 | −3740 | −2836 | −1640 | 3156 | 1003 | −1991 | −2066 | 48 | −3346 | −3910 | −3195 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 115 | −3516 | −4183 | −3603 | −3801 | −6130 | 3582 | −4039 | −6038 | −3385 | −5951 | −5222 | 326 | −4689 | −3784 | 615 | −3629 | −3840 | −5130 | −5730 | −5552 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 116 | 1547 | −3079 | −5782 | −6029 | −5507 | −3403 | −5033 | −4985 | −5679 | −5494 | −4625 | −4203 | −4203 | −5147 | −5329 | 2749 | −592 | 1813 | −5803 | −5718 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 117 | −1943 | −2092 | −3044 | 554 | 1704 | −3296 | 682 | 123 | −537 | −29 | 1388 | −427 | −3363 | −57 | −2487 | −9 | −347 | 218 | −2514 | 2352 | 136 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 118 | −3487 | −3118 | −5928 | −5415 | 1144 | −5388 | −4257 | 2699 | −5129 | 325 | −1791 | −5008 | −5230 | −4671 | −4957 | −4567 | −3435 | 2186 | −3767 | 1432 | 137 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 119 | −4735 | −5859 | −2610 | 3771 | −6551 | −4479 | −3727 | −6512 | 691 | −6208 | −5677 | −3253 | −4970 | −3428 | −3564 | −4433 | −4760 | −6070 | −5892 | −5530 | 138 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 120 | 132 | −3241 | 1504 | 944 | −554 | −2769 | 1858 | 415 | −1014 | −3252 | −2332 | 1352 | −2862 | −973 | 1214 | −1677 | 854 | −2857 | −3430 | −2753 | 139 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 121 | −690 | −4863 | −4765 | −3505 | −5836 | −4677 | −2596 | −5105 | 3490 | −4724 | −4065 | 1698 | −4641 | −2176 | 858 | −4077 | −3886 | −4868 | −4544 | −4473 | 140 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 122 | −2914 | −4463 | 1405 | 1760 | −4789 | 1324 | −2316 | −4550 | 2176 | −4439 | −3602 | −2037 | −3710 | −1905 | 1324 | −2715 | −2877 | −4098 | −4570 | −3859 | 141 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 123 | 826 | 1125 | −4318 | −3684 | 2126 | −3546 | 878 | 240 | −3285 | −1682 | 1104 | −3183 | −3597 | −2914 | −3096 | 1219 | 1395 | 503 | −2291 | −1948 | 142 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 124 | 2482 | 3224 | −5595 | −5649 | −4986 | 733 | −4708 | −4669 | −5307 | −4973 | 1934 | −4098 | −4153 | −4843 | −5052 | 824 | 117 | −3855 | −5321 | −5146 | 143 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |

-continued

| | | | | | | | | | | | | | | | | | | | | |
|---|---|---|---|---|---|---|---|---|---|---|---|---|---|---|---|---|---|---|---|---|
| 125 | −3388 | −3089 | −5760 | −5149 | 324 | −5094 | −3945 | 1605 | −4798 | 1681 | 1706 | −4749 | −4922 | −4224 | −4542 | −4227 | −3310 | 2005 | −3457 | 1647 | 144 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 126 | 1703 | −2174 | −2959 | −2388 | −2193 | −3277 | −2079 | 710 | −241 | −2061 | −1377 | −2419 | −3359 | −2048 | −140 | 1338 | 954 | 1310 | −2607 | −2204 | 145 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 127 | 173 | −2299 | −4874 | −4256 | 1719 | −4121 | −2993 | 285 | −3870 | 360 | −1246 | −3766 | −4122 | −3461 | −3667 | −3221 | −2453 | 1613 | 4694 | −2440 | 146 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 128 | −3534 | 1422 | −4289 | −4564 | −4269 | −4171 | 5154 | −5976 | −4550 | −5888 | −5292 | 1328 | −4853 | −4581 | −4578 | −3708 | −3928 | −5096 | −4698 | −3849 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 129 | −5701 | −4824 | −6403 | −6629 | 1772 | −6218 | 2142 | −4685 | −6188 | −647 | −4146 | −4932 | −6098 | −5035 | −5622 | −5443 | 643 | −4795 | −1841 | 4209 | 148 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 130 | −4364 | −4966 | −5068 | 522 | −5928 | −4791 | −2597 | −5149 | 718 | −4743 | −4098 | −3448 | −4708 | 2137 | 3535 | −4221 | −3986 | −4946 | −4545 | −4504 | 149 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 131 | −1793 | −3260 | 307 | 665 | −368 | −2767 | −1426 | −3327 | 9 | −337 | −2350 | 2539 | −2860 | 1301 | 1379 | −1675 | −1732 | −2881 | −3444 | 980 | 150 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 132 | 3070 | 1688 | −5853 | −6024 | −5047 | −3510 | −4990 | −3529 | −5652 | −4737 | −4110 | −4276 | −4277 | −5145 | −5314 | −2865 | −329 | 1794 | −5544 | −5378 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 133 | 328 | −3406 | 2678 | 1115 | −3727 | −2855 | −1560 | −3479 | −1167 | −3428 | −2510 | 191 | 1160 | −1107 | −1683 | −206 | 32 | −724 | −3600 | −2911 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 134 | −1796 | −3256 | 2139 | 1191 | −3570 | −2770 | 667 | −712 | −1014 | −3269 | −2346 | −1407 | 2129 | 507 | 276 | −1679 | −147 | −776 | −3442 | −2763 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 135 | −1788 | −3261 | 1985 | 1502 | −3582 | −2762 | 1005 | −3333 | 504 | −890 | −2350 | −7 | −17 | 1180 | −38 | −532 | −146 | −2883 | −3444 | 203 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −846 | −9479 | −1177 | −894 | −1115 | −701 | −1378 | * | * | | | | | | | | | | | | |
| 136 | −1901 | −1780 | 1351 | −3078 | 2990 | −3321 | −1715 | 792 | −2791 | −76 | −972 | 477 | −3363 | −2441 | −2741 | −2397 | −1839 | −1218 | −1457 | 2135 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8638 | −9680 | −894 | −1115 | −3505 | −133 | * | * | | | | | | | | | | | | |
| 137 | −1976 | −2618 | −3596 | −3612 | −4922 | 3271 | −3366 | −4711 | −2789 | −4799 | −3943 | −3007 | −3494 | −3154 | 1664 | 357 | −2377 | −3654 | −4820 | −4652 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8638 | −9680 | −894 | −1115 | −1728 | −519 | * | * | | | | | | | | | | | | |
| 138 | 553 | −2817 | −1296 | 1634 | −3122 | −2399 | −1055 | −2847 | 534 | −2823 | −1920 | −1049 | −2493 | −606 | 1012 | 1246 | −1361 | 1334 | −3014 | −2358 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | −8898 | −9940 | −894 | −1115 | −3158 | −171 | * | * | | | | | | | | | | | | |
| 139 | 907 | 2815 | −3807 | −3177 | 2302 | −3079 | −1946 | −871 | 209 | 630 | −580 | −2699 | 224 | −2427 | −2617 | −2160 | −1481 | 305 | 1801 | −1490 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | −8898 | −9940 | −894 | −1115 | −299 | −2419 | * | * | | | | | | | | | | | | |
| 140 | −161 | −3220 | −1590 | 19 | −3541 | −2720 | 853 | −3291 | −957 | −3235 | −2310 | 730 | −2815 | 3181 | 856 | 884 | −76 | −2842 | −3403 | −2721 | 159 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9409 | −10451 | −894 | −1115 | −385 | −2093 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 141 | 2117 | −2168 | −2851 | −300 | −2173 | −3243 | −2012 | −1735 | −323 | −730 | 1212 | −2337 | −3313 | −1960 | 63 | −489 | −1872 | 1394 | 2821 | −2170 | 160 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 142 | −1790 | −3230 | 629 | −38 | −3537 | −1086 | −1429 | 416 | 1793 | −323 | −2323 | −207 | −532 | −974 | 1514 | −516 | −365 | −663 | 1831 | −2747 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 143 | 1197 | −3500 | 1016 | 2308 | −3810 | 273 | −1627 | −3565 | −1249 | 151 | −2600 | 2 | −3041 | −1178 | 190 | −1885 | −1963 | −3118 | −3686 | −2989 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 144 | 396 | 2649 | −388 | 289 | −1828 | −3575 | −2444 | 246 | −3275 | 1909 | 1540 | −3190 | −3624 | −2916 | −3109 | −2657 | −1973 | 680 | −2336 | −1992 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 145 | 1549 | −2881 | −174 | −178 | 180 | −2874 | −1555 | −608 | 756 | 1034 | 1599 | −1593 | −2962 | 1087 | −149 | −1799 | −1763 | −2423 | −3159 | −2579 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 146 | 443 | −3256 | 807 | 1661 | −3575 | −2763 | −1422 | 412 | 776 | −1160 | −2346 | −7 | −2856 | 1401 | −38 | −1669 | 624 | −1071 | −3441 | −2759 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 147 | 345 | 2182 | −2627 | −2062 | −2287 | −3171 | 2964 | −1859 | −318 | 510 | 1680 | 984 | −3245 | 841 | −2227 | −2155 | 636 | −437 | −2661 | −2229 | 166 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 148 | −389 | 1592 | −4258 | −673 | −1861 | −3578 | 2353 | −1348 | −3264 | 2192 | −1100 | −3191 | −3637 | −2919 | −3113 | −2663 | −1995 | 1573 | −2371 | −2026 | 167 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 149 | −1796 | −3219 | −267 | 2104 | −3520 | −2777 | 852 | 419 | −71 | −1200 | 952 | −1420 | −2870 | 1299 | 1205 | −1686 | −1735 | −2830 | 2875 | −2744 | 168 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 150 | −488 | −3277 | 577 | 1063 | −3596 | −2773 | −1436 | −3347 | −1019 | −3292 | −2367 | 955 | −2869 | −977 | 1267 | 1683 | 1331 | −2898 | −3461 | 206 | 169 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −61 | −9479 | −4634 | −894 | −1115 | −701 | −1378 | * | * | | | | | | | | | | | | |
| 151 | 462 | −1793 | −4292 | −3658 | −1749 | 44 | 750 | 950 | −3258 | 482 | 1088 | −3152 | −3562 | −2885 | −3065 | −2597 | 700 | 2330 | −2254 | −1912 | 170 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9420 | −10463 | −894 | −1115 | −416 | −1998 | * | * | | | | | | | | | | | | |
| 152 | −2001 | 1510 | −4292 | −3 | 127 | −189 | −2411 | −141 | −3266 | 1385 | 809 | 181 | 1175 | −2900 | −3086 | −2625 | −87 | 990 | −2292 | 414 | 171 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 153 | −714 | 928 | −1726 | 148 | 876 | −2806 | 711 | 698 | 1149 | −1109 | −2203 | 402 | −2897 | 1327 | 577 | −467 | 850 | −916 | −3322 | −2684 | 172 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 154 | 602 | −3239 | 2013 | −1098 | 200 | −2768 | 938 | −432 | 6 | −3250 | −2331 | 1418 | −2860 | −971 | 275 | 1084 | −365 | −2855 | −3428 | −2752 | 173 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 155 | −586 | −3262 | 1067 | 739 | −3582 | 119 | 1554 | −3332 | 775 | −3278 | −2352 | 1639 | −2859 | −965 | −1513 | −1672 | −275 | −2884 | 1594 | 2346 | 174 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −695 | −9479 | −1392 | −894 | −1115 | −701 | −1378 | * | * | | | | | | | | | | | | |
| 156 | 647 | −1395 | −3406 | −2800 | 669 | −2986 | −1795 | −900 | −2475 | −1244 | −596 | −2477 | 2574 | −2178 | 1220 | −2052 | −1436 | 686 | 2025 | 901 | 175 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8788 | −9830 | −894 | −1115 | −284 | −2485 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 157 | 399 | −3350 | 2084 | −1103 | −3669 | 848 | −1485 | −3424 | 970 | −3367 | −2447 | 182 | 1739 | 551 | −1605 | −448 | −1810 | −2972 | −3535 | −2843 | 176 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9401 | −10443 | −894 | −1115 | −1479 | −641 | * | * | | | | | | | | | | | | |
| 158 | −2877 | 1696 | −5267 | −4665 | −2279 | −4568 | −3482 | 934 | −4305 | 1720 | 1187 | −4219 | −4504 | −3858 | −4100 | −3688 | −2815 | 2365 | 2655 | −2903 | 177 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9401 | −10443 | −894 | −1115 | −1479 | −641 | * | * | | | | | | | | | | | | |
| 159 | 760 | −3196 | 567 | 1356 | −3515 | −2704 | 1875 | −874 | 794 | −3211 | −2286 | −1340 | −2797 | −903 | 1563 | 443 | −1668 | −52 | −3381 | −2700 | 178 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9401 | −10443 | −894 | −1115 | −366 | −2156 | * | * | | | | | | | | | | | | |
| 160 | 898 | −3258 | −6400 | −6040 | −3744 | −6154 | −5901 | 1388 | −5953 | 1065 | −2488 | −5817 | −5915 | −5799 | −6035 | −5483 | −3730 | 2910 | −5328 | −4899 | 179 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 161 | −1796 | −3184 | 143 | −1128 | −3470 | −2783 | −1445 | −3197 | 1333 | −3185 | 2026 | −140 | −2875 | 1591 | −1541 | −341 | 1913 | 58 | −3388 | 1239 | 180 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 162 | −539 | −3166 | −169 | −1136 | −3445 | −2787 | 2292 | −202 | 229 | −1132 | −2266 | −1439 | −252 | 2084 | 1264 | −1697 | 1045 | 299 | −3375 | −2718 | 181 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 163 | −571 | −3918 | −2622 | −2731 | −3648 | 3409 | 1029 | −4572 | −2884 | −4592 | −3927 | −2872 | −4209 | 532 | −3156 | −3148 | −3296 | −4130 | −4058 | 540 | 182 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 164 | −2571 | −3879 | −2518 | −1863 | −4329 | −828 | 554 | −3976 | 2588 | −3835 | −2979 | 1196 | −3508 | 1356 | 2214 | −665 | −2460 | −3579 | −3895 | −3389 | 183 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 165 | 579 | 1177 | 850 | 230 | −3582 | −2762 | 2167 | −3332 | 1515 | −3277 | 2232 | 211 | −2855 | 861 | −125 | −334 | −1727 | −2883 | −3444 | −2761 | 184 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 166 | −2120 | −1936 | −4466 | −3837 | 247 | −3688 | −2570 | 1331 | −3440 | 154 | 1291 | 1185 | −3731 | −3066 | −3247 | 29 | −2062 | 2573 | −2430 | −2087 | 185 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 167 | −4110 | −3586 | −6719 | −6316 | 73 | −6518 | −5973 | 1542 | −6217 | 1353 | −1958 | −6184 | −6057 | −5688 | −6124 | −5871 | −4066 | 3015 | −4949 | −4815 | 186 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 168 | −2997 | −3657 | −2625 | 3614 | 182 | −3673 | −3259 | −3744 | −3558 | −4153 | −3602 | −2945 | −4203 | −3204 | −3974 | −489 | −3207 | −150 | −4181 | −3357 | 187 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 169 | −3812 | 1649 | −6488 | −6153 | −3826 | −6310 | −6206 | 1666 | −6103 | 1027 | −2536 | −5966 | −6031 | −5983 | −6227 | −5673 | −3798 | 3073 | −5538 | −5092 | 188 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 170 | −4473 | −4994 | −5700 | −3778 | −6003 | −4887 | 1029 | −5183 | 2069 | −4760 | −4126 | −3548 | −4770 | 1233 | 3478 | −4337 | −4059 | −4998 | −4547 | −4540 | 189 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 171 | −614 | −3250 | −4284 | −4565 | −5778 | −3431 | −4617 | −5603 | −4857 | −5804 | −4881 | −3828 | 3842 | 1175 | −4862 | 690 | −3052 | −4382 | −5939 | −5749 | 190 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 172 | 189 | −3227 | 760 | −1104 | −3533 | −2770 | −1431 | −759 | −1017 | −3237 | −2320 | 1068 | −17 | 1629 | 1162 | 374 | 475 | 995 | −3420 | −2746 | 191 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 173 | −1990 | −1889 | −3920 | −3309 | 900 | 2098 | −2335 | 1514 | 709 | −364 | −1089 | −2989 | −3542 | −2688 | 544 | −700 | −1931 | −384 | −2339 | 490 | 192 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 174 | 139 | −2235 | 645 | −2122 | −2252 | −3191 | 1143 | −265 | 956 | 489 | −1416 | −2223 | −3264 | −1837 | −2268 | −547 | −88 | 2191 | −2636 | −2211 | 193 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 175 | −415 | −2816 | −3196 | −2757 | −3153 | −3302 | −2669 | −3023 | −2646 | −3262 | −2529 | 2293 | −3661 | −2521 | −2965 | 2288 | −359 | −2731 | 3854 | 718 | 194 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1761 | −9479 | −507 | −894 | −1115 | −701 | −1378 | * | * | | | | | | | | | | | | |
| 176 | −2392 | −4185 | 3598 | −443 | −4470 | −2197 | −1676 | −4544 | −2069 | −4397 | −3823 | 2029 | −2784 | −1379 | −3009 | −2044 | −2512 | −3969 | −4482 | −3460 | 195 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7728 | −8770 | −894 | −1115 | −362 | −2172 | * | * | | | | | | | | | | | | |
| 177 | −6468 | −5794 | −6279 | −6066 | −7061 | −5716 | −5298 | −7572 | 4053 | −7055 | −6716 | −5990 | −6075 | −5251 | −4350 | −6634 | −6440 | −7266 | −5880 | −6603 | 196 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | −9255 | −10297 | −894 | −1115 | −673 | −1424 | * | * | | | | | | | | | | | | |
| 178 | −3792 | −4239 | −5211 | −4992 | −5479 | 3549 | −4320 | −5529 | −3435 | 76 | −4851 | −4502 | −4984 | −4149 | 309 | −3994 | −4098 | −5024 | −5353 | −5222 | 197 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9401 | −10443 | −894 | −1115 | −1479 | −641 | * | * | | | | | | | | | | | | |
| 179 | 252 | −3189 | 676 | 676 | 950 | −706 | −1367 | −3249 | 1698 | 535 | −2280 | −1345 | −2801 | 310 | −1457 | 813 | −1671 | −2807 | −3376 | −2698 | 198 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9401 | −10443 | −894 | −1115 | −366 | −2156 | * | * | | | | | | | | | | | | |
| 180 | 2697 | 1569 | −5768 | −5354 | −3407 | −4841 | −4534 | 1989 | −5093 | −2673 | −2364 | −4791 | −5009 | −4818 | −5002 | −4087 | 31 | 992 | −4353 | −3963 | 199 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 181 | 1917 | −2949 | −5877 | −5407 | −3308 | −5379 | −4662 | 1338 | −5174 | 1131 | −2224 | −5043 | −5289 | −4920 | −5117 | −4587 | −747 | 2210 | −4370 | −3978 | 200 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 182 | 262 | −3261 | 970 | 1972 | −3582 | −995 | 448 | −3333 | 607 | −1554 | 946 | −27 | −2855 | 475 | 875 | −1668 | 380 | −2883 | −3444 | −2761 | 201 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 183 | 262 | −3264 | 185 | 154 | 1942 | −2775 | 668 | −3330 | 1017 | −3278 | −2354 | −1412 | −2868 | 335 | 2173 | −1683 | −1740 | −2885 | 2567 | −2769 | 202 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 184 | −3564 | −3209 | −5994 | −5429 | 1624 | −5419 | −4374 | 2530 | −254 | 1907 | −1515 | −5075 | −5209 | −4580 | −4903 | −4588 | −3497 | 676 | −3836 | −3647 | 203 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 185 | −2333 | −2140 | −4680 | −4047 | 1061 | −927 | −2765 | 1366 | −3649 | 2180 | 1938 | −3548 | −3916 | −3238 | −3439 | −2992 | −2270 | 479 | −2570 | 769 | 204 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 186 | −622 | −3261 | 212 | 1633 | −3582 | 554 | −1421 | −3333 | 1094 | −3277 | −2350 | −1397 | −2855 | 1571 | 590 | 738 | −336 | −2883 | 1343 | −2762 | 205 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 187 | 336 | −3260 | 153 | 1586 | 858 | −2763 | 1449 | −3329 | −1003 | −3275 | −2349 | −1399 | −2857 | 391 | 1307 | 1213 | 340 | −2881 | −3444 | −2762 | 206 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 188 | −375 | −2328 | −315 | −1946 | −2363 | −450 | −1870 | 397 | −1805 | 956 | 2300 | 295 | −350 | 135 | −2149 | 412 | −1839 | −1789 | −2714 | 2154 | 207 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −81 | −9479 | −4226 | −894 | −1115 | −701 | −1378 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 189 | −1737 | −3201 | 214 | −20 | −3517 | 1601 | 1510 | −3265 | −953 | −1399 | −2291 | 1013 | 1762 | 336 | −129 | −1619 | −1676 | 550 | −3386 | −2706 | 208 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −128 | −9401 | −3589 | −894 | −1115 | −1479 | −641 | * | * | | | | | | | | | | | | |
| 190 | −1697 | −2479 | −1933 | 822 | 1579 | 458 | 2479 | −2199 | −1268 | −937 | −1631 | 18 | −334 | −1196 | −1699 | 967 | −1636 | −22 | −2809 | 1118 | 209 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −265 | −9276 | −2587 | −894 | −1115 | −2172 | −362 | * | * | | | | | | | | | | | | |
| 191 | 1497 | −2916 | 533 | 194 | −3234 | −249 | −1082 | −91 | 981 | −2931 | −2006 | 317 | −2516 | −624 | −1172 | 1352 | −22 | −2536 | −3101 | −2419 | 210 |
| — | −151 | −502 | 232 | 44 | −383 | 398 | 107 | −626 | 214 | −465 | −715 | 273 | 397 | 47 | 93 | 360 | 118 | −369 | −297 | −252 | |
| — | −2585 | −1672 | −945 | −2074 | −391 | −646 | −1469 | * | * | | | | | | | | | | | | |
| 192 | −1144 | −2583 | 1670 | 573 | −2891 | −2120 | −780 | −2632 | 1620 | −2593 | 2083 | −760 | −2213 | −325 | 373 | 337 | −1083 | 535 | −2774 | −2100 | 224 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8553 | −9595 | −894 | −1115 | −1598 | −578 | * | * | | | | | | | | | | | | |
| 193 | −3050 | −4533 | 1905 | −1492 | −5391 | 2488 | −2666 | −5325 | −3002 | −5233 | −4566 | 2321 | −3688 | −2358 | −3873 | −2820 | 964 | −4649 | −5428 | −4446 | 225 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8883 | −9925 | −894 | −1115 | −3182 | −168 | * | * | | | | | | | | | | | | |
| 194 | −1382 | 2214 | −1352 | 822 | −2818 | −2399 | −1079 | 546 | 1376 | −2569 | −1713 | −1091 | 969 | −661 | −1189 | 1591 | 135 | −2161 | −2842 | −2227 | 226 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8883 | −9925 | −894 | −1115 | −3182 | −168 | * | * | | | | | | | | | | | | |
| 195 | 711 | −2383 | 858 | 170 | −2541 | −2449 | −1134 | −2187 | −816 | 662 | 1099 | −1183 | 1314 | −757 | 1059 | −1377 | 97 | −147 | −2673 | −2107 | 227 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8883 | −9925 | −894 | −1115 | −575 | −1606 | * | * | | | | | | | | | | | | |
| 196 | −1808 | −2005 | 1430 | −2230 | −2005 | 342 | −1916 | 1148 | −2054 | −45 | −1192 | 33 | 2175 | −1896 | −2295 | −787 | −1749 | −35 | −2422 | 850 | 228 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9316 | −10358 | −894 | −1115 | −1993 | −417 | * | * | | | | | | | | | | | | |
| 197 | −1707 | −3057 | 2449 | 521 | −3330 | −2689 | −1362 | −3046 | −966 | −634 | −2163 | −1345 | −2787 | −921 | 1645 | 407 | −7 | 634 | −3272 | −2620 | 229 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9316 | −10358 | −894 | −1115 | −247 | −2671 | * | * | | | | | | | | | | | | |
| 198 | −2003 | 1205 | −4337 | −3702 | 3106 | −3549 | −2420 | −1323 | −3299 | 438 | 1377 | −3192 | −3599 | −2924 | −354 | 382 | −87 | 302 | −2288 | 1144 | 230 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 199 | 360 | −2261 | −4825 | −4245 | −2365 | −4046 | −3092 | 1606 | −3883 | −825 | −1536 | −3748 | 2368 | −3538 | −3725 | 271 | −2420 | 2052 | −2964 | −2612 | 231 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −70 | −9479 | −4434 | −894 | −1115 | −701 | −1378 | * | * | | | | | | | | | | | | |
| 200 | −2963 | −2695 | −5347 | −4742 | 1763 | −602 | −3552 | 1946 | −4382 | 1808 | 721 | −4303 | −4569 | −3910 | −4166 | −3772 | −2898 | 1467 | −3210 | −2959 | 232 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9411 | −10454 | −894 | −1115 | −1395 | −690 | * | * | | | | | | | | | | | | |
| 201 | 468 | 4606 | −4324 | −3769 | 408 | −3609 | −2525 | −1728 | −3408 | −2058 | −1423 | −3278 | −3760 | 191 | −3290 | −2731 | −199 | −1631 | −2385 | 2737 | 233 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9411 | −10454 | −894 | −1115 | −1395 | −690 | * | * | | | | | | | | | | | | |
| 202 | 1324 | −2593 | −5347 | −4810 | −2779 | −4674 | −3791 | 2850 | −4495 | 1134 | −1825 | −4361 | −4674 | −4173 | −4364 | −805 | −2849 | 675 | −3584 | −3224 | 234 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9411 | −10454 | −894 | −1115 | −1395 | −690 | * | * | | | | | | | | | | | | |
| 203 | −2462 | −3077 | −5365 | −5721 | −5783 | 3619 | −5031 | −5618 | −5660 | −5871 | −4903 | −4105 | −4156 | −5100 | −5339 | −72 | −79 | −4291 | −5993 | −5956 | 235 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9411 | −10454 | −894 | −1115 | −1395 | −690 | * | * | | | | | | | | | | | | |
| 204 | −4007 | −6051 | 3830 | −1896 | −6072 | −3708 | 1799 | −6236 | −3650 | −6048 | −5526 | 1291 | −4312 | −2891 | −4685 | −3603 | −4122 | −5658 | −6151 | −5002 | 236 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9411 | −10454 | −894 | −1115 | −1395 | −690 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 205 | −4542 | −4679 | 3932 | −3772 | 1064 | −4893 | −3337 | −154 | −5033 | −3463 | −3538 | −3865 | −5286 | −4265 | −5370 | −4589 | −4649 | −3612 | −3028 | −1921 | 237 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9411 | −10454 | −894 | −1115 | −392 | −2072 | * | * | | | | | | | | | | | | |
| 206 | −2014 | −1909 | −3967 | −3346 | 901 | −3512 | −2351 | 990 | −414 | 1054 | −1104 | −3016 | 35 | 124 | 2420 | −2580 | −1954 | 672 | −2358 | −2007 | 238 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 207 | −237 | −3242 | 123 | −4313 | −5704 | −663 | −4493 | −5522 | −4837 | −5720 | −4791 | −3716 | −4168 | −4367 | −4955 | 1303 | 3455 | −4336 | −5881 | −5635 | 239 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2634 | −9479 | −256 | −894 | −1115 | −701 | −1378 | * | * | | | | | | | | | | | | |
| 208 | −1191 | −2088 | −994 | −631 | −2776 | −1843 | −609 | −2439 | 2770 | −2372 | −1636 | −776 | 2113 | −229 | 126 | −1147 | −1167 | −2074 | −2390 | −2024 | 240 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −19 | −6863 | −7905 | −894 | −1115 | −46 | −5004 | * | * | | | | | | | | | | | | |
| 209 | −3953 | −5105 | 4019 | −2597 | −6313 | −3984 | −3790 | −6453 | −4284 | −6345 | −5751 | −2927 | −4626 | −3538 | −5155 | 387 | −4207 | −5651 | −6238 | −5503 | 241 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 210 | −409 | −5583 | 424 | 3530 | −5788 | −3645 | −2986 | −5709 | −3214 | −5575 | −4891 | −2239 | −4171 | 295 | −4062 | −531 | −3759 | −5175 | −5769 | −4756 | 242 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 211 | −596 | −3897 | 3228 | −311 | −4201 | −735 | −1926 | −3975 | −1624 | −3910 | −3015 | 192 | −3304 | 397 | −2178 | 846 | 39 | −3515 | −4081 | −3348 | 243 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 212 | 1641 | −2074 | −4428 | −3857 | −2143 | −569 | −2725 | −114 | −3497 | −1993 | 4152 | −59 | −3773 | −3152 | −3356 | −2748 | −2158 | 691 | −2659 | −2315 | 244 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −70 | −9479 | −4434 | −894 | −1115 | −701 | −1378 | * | * | | | | | | | | | | | | |
| 213 | −5917 | −4919 | −6429 | −6742 | 4268 | −6285 | −2543 | −4715 | −6301 | −1039 | −4118 | −4942 | −64 | −5060 | −5686 | −5532 | −5781 | −4924 | −1791 | 1614 | 245 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9411 | −10454 | −894 | −1115 | −392 | −2072 | * | * | | | | | | | | | | | | |
| 214 | 262 | −3263 | 1575 | 1158 | −279 | −2764 | −1424 | −3333 | 916 | −3278 | −2352 | −1400 | −2858 | −964 | 1568 | 919 | 397 | −2884 | −3446 | −2764 | 246 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 215 | −55 | −2670 | −122 | 42 | 683 | −2955 | −1653 | −394 | −1393 | −2594 | −1818 | −242 | −422 | 234 | −1830 | 509 | −218 | 2202 | 1871 | −2466 | 247 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 216 | −506 | 1512 | −4348 | −3712 | 1816 | −653 | −2422 | 1643 | −3307 | 708 | 1296 | −3197 | −3601 | 95 | −3107 | −2635 | −1944 | 1456 | −2288 | 254 | 248 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 217 | −1790 | −3242 | −1646 | 962 | −3554 | −1086 | 782 | −3298 | 936 | 82 | 479 | 2021 | −2860 | −969 | 1680 | −623 | −345 | −849 | −3430 | −2753 | 249 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −101 | −9479 | −3916 | −894 | −1115 | −701 | −1378 | * | * | | | | | | | | | | | | |
| 218 | 231 | −3186 | −183 | 501 | −3507 | −353 | 523 | −3258 | 1193 | −3202 | −2275 | 1155 | 1092 | 550 | 827 | 132 | 405 | −2808 | −3369 | −2686 | 250 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −87 | −9381 | −4128 | −894 | −1115 | −1618 | −569 | * | * | | | | | | | | | | | | |
| 219 | −457 | −3043 | −1538 | 606 | 1019 | −738 | 803 | −495 | 251 | 514 | −2141 | 193 | −2736 | 602 | 721 | −1553 | 1552 | −2646 | −3248 | −2587 | 251 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −655 | −9297 | −1461 | −894 | −1115 | −2081 | −389 | * | * | | | | | | | | | | | | |
| 220 | 176 | −2637 | 158 | 772 | −2943 | −2177 | −838 | −2683 | 1795 | 586 | −1730 | −818 | 1092 | 842 | −929 | −1086 | −1139 | −370 | −2829 | −2155 | 252 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −511 | −8648 | −1757 | −894 | −1115 | −3495 | −134 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 221 | −1114 | −2129 | 1507 | −688 | 1061 | −2044 | −1014 | −2244 | −741 | −2362 | −1540 | −932 | 2169 | −640 | −1217 | 1341 | 496 | −1891 | −2664 | −2073 | 253 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −153 | −8144 | −3368 | −894 | −1115 | −3899 | −100 | * | * | | | | | | | | | | | | |
| 222 | 1156 | −2163 | −756 | 1169 | −2523 | 211 | −586 | −2238 | −208 | −2255 | −1369 | 869 | −1969 | −152 | −706 | 1299 | −833 | 227 | −2480 | −1835 | 254 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8000 | −9042 | −894 | −1115 | −3978 | −95 | * | * | | | | | | | | | | | | |
| 223 | −887 | −2361 | 843 | −140 | −2680 | −1819 | −507 | −2431 | −100 | −2376 | −1457 | 1212 | 1306 | 1149 | 1228 | 1255 | −829 | −1983 | −2545 | −1859 | 255 |
| — | −149 | −500 | 233 | 43 | −381 | 400 | 105 | −627 | 210 | −466 | −721 | 275 | 395 | 45 | 96 | 359 | 119 | −370 | −295 | −250 | |
| — | −758 | −1826 | −2982 | −572 | −1612 | −1197 | −827 | * | * | | | | | | | | | | | | |
| 224 | −27 | −2471 | −1189 | 282 | 260 | −312 | 1525 | −2390 | −547 | −2447 | 2274 | 510 | −201 | 1212 | −1035 | 595 | −1177 | 639 | −2711 | −2089 | 258 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8694 | −9736 | −894 | −1115 | −398 | −2053 | * | * | | | | | | | | | | | | |
| 225 | −1695 | −3018 | −1604 | 6 | 52 | 1067 | 1472 | −646 | 349 | −453 | −2123 | −1354 | 532 | 334 | −1461 | 1485 | 510 | −2608 | −3238 | −2593 | 259 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −62 | −9342 | −4629 | −894 | −1115 | −1856 | −467 | * | * | | | | | | | | | | | | |
| 226 | −417 | −3097 | −1496 | −947 | −3411 | 2105 | 1087 | −3156 | 943 | −1308 | 909 | 530 | −2711 | 621 | 52 | 205 | −112 | −2715 | −3285 | −2606 | 260 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9284 | −10326 | −894 | −1115 | −220 | −2819 | * | * | | | | | | | | | | | | |
| 227 | −2003 | 1144 | −4341 | −3705 | 9 | −3550 | −2420 | 943 | −182 | 1048 | 1701 | 827 | −527 | −2926 | −3104 | −2634 | −1943 | 1518 | −2288 | 1794 | 261 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 228 | −566 | −3210 | −1661 | 660 | −3508 | 823 | 959 | −494 | −1025 | −1251 | −2305 | 58 | 919 | 990 | −101 | 1033 | 17 | −802 | 1347 | −2738 | 262 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −55 | −9479 | −4800 | −894 | −1115 | −701 | −1378 | * | * | | | | | | | | | | | | |
| 229 | −565 | −2594 | 590 | −1507 | −2697 | −2937 | 798 | 2406 | 544 | −2513 | −1746 | −1739 | −640 | −1321 | −186 | −1881 | −434 | 1614 | −2925 | −2408 | 263 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9427 | −10469 | −894 | −1115 | −435 | −1941 | * | * | | | | | | | | | | | | |
| 230 | −1829 | −3261 | 725 | 2041 | −3568 | −2800 | −1461 | −3306 | 848 | 532 | −2356 | −1442 | −2896 | −1007 | 1118 | −491 | −1768 | 949 | −3451 | −2781 | 264 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 231 | −632 | −1875 | −624 | −3388 | 1087 | −3501 | −2354 | 1716 | −578 | −629 | −1076 | −3032 | 32 | −2739 | −453 | −2571 | −283 | 2381 | −2328 | −1977 | 265 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 232 | −412 | −2247 | −256 | −2096 | 1989 | 1180 | −1936 | −1836 | −1942 | 46 | −1426 | −2203 | −471 | −1816 | 750 | 899 | −354 | −200 | −2646 | 277 | 266 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 233 | 1308 | 2124 | 61 | −1379 | 655 | −2901 | 1861 | −2600 | −187 | −1069 | −1943 | −1642 | 504 | −1217 | −1737 | 1122 | 770 | −2335 | −3101 | −2540 | 267 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 234 | −542 | 2664 | −224 | −1328 | 260 | −561 | −1559 | −469 | 190 | −2819 | −2000 | −49 | −344 | 556 | −1698 | 120 | 1450 | 1090 | −3150 | −2572 | 268 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −197 | −9479 | −2987 | −894 | −1115 | −701 | −1378 | * | * | | | | | | | | | | | | |
| 235 | −1692 | −3161 | 528 | 1467 | −3480 | 192 | −1321 | −3230 | −912 | −3178 | −2255 | −1283 | 474 | 487 | −1422 | 1673 | 1232 | −521 | −3348 | −2664 | 269 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −473 | −9285 | −1846 | −894 | −1115 | −2134 | −373 | * | * | | | | | | | | | | | | |
| 236 | −1334 | −2427 | 659 | −807 | −2613 | 727 | 1193 | 316 | 425 | −2384 | −1554 | 471 | −2465 | −657 | −1186 | −29 | −1274 | 1790 | −2698 | 822 | 270 |
| — | −149 | −487 | 233 | 43 | −381 | 398 | 105 | −627 | 210 | −466 | −721 | 275 | 396 | 45 | 96 | 360 | 117 | −370 | −295 | −250 | |
| — | −412 | −2015 | −9859 | −58 | −4659 | −3283 | −156 | * | * | | | | | | | | | | | | |

-continued

| | | | | | | | | | | | | | | | | | | | | | |
|---|---|---|---|---|---|---|---|---|---|---|---|---|---|---|---|---|---|---|---|---|---|
| 237 | −1865 | −2518 | −3579 | −3587 | −4612 | 2963 | −3582 | −4353 | −3739 | −4574 | −3697 | 522 | 801 | −3431 | −3891 | 1092 | −2267 | 467 | −4819 | −4529 | 272 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8817 | −9859 | −894 | −1115 | −3283 | −156 | * | * | | | | | | | | | | | | |
| 238 | −84 | −2785 | 839 | 664 | −3106 | −318 | −943 | −2857 | −525 | −2801 | −1875 | 281 | −2377 | 1890 | 853 | 1396 | 355 | −2407 | −2969 | −2285 | 273 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −5 | −8817 | −9859 | −894 | −1115 | −910 | −1096 | * | * | | | | | | | | | | | | |
| 239 | −271 | −3004 | −1447 | 415 | −3305 | −2561 | 1152 | −3042 | 2267 | −3011 | 686 | −1204 | −126 | −768 | 1032 | 580 | −1519 | −138 | 1561 | −2529 | 274 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −4 | −9196 | −10238 | −894 | −1115 | −1442 | −662 | * | * | | | | | | | | | | | | |
| 240 | 993 | −3126 | 592 | 18 | −3446 | −595 | 2102 | −3197 | 418 | −3142 | −2216 | −1255 | 2458 | −824 | 4 | −327 | −1592 | −2748 | −3309 | −2626 | 275 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9276 | −10319 | −894 | −1115 | −215 | −2850 | * | * | | | | | | | | | | | | |
| 241 | −1987 | −1920 | −3774 | −3173 | −1889 | −387 | −2308 | 38 | −2880 | −680 | −1122 | 877 | −3521 | −2605 | −2876 | 1966 | 2065 | 548 | −2371 | 325 | 276 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 242 | 327 | 999 | −41 | −35 | −3550 | −803 | −1427 | 268 | 1168 | −312 | −2331 | 1344 | −2860 | 507 | −1517 | 897 | −274 | −2856 | −3428 | 145 | 277 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 243 | 2567 | −3362 | −17 | 1028 | −3682 | 563 | −1572 | −653 | −1183 | −3391 | −2483 | −1512 | −2986 | −1124 | −133 | −148 | −1880 | −2990 | −3578 | −2899 | 278 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 244 | −270 | −3136 | −219 | −1152 | 603 | −770 | −1459 | −728 | 1447 | −95 | −2239 | 178 | 652 | −1019 | 207 | 256 | 1080 | −2728 | −3352 | 137 | 279 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 245 | −2021 | −1881 | −4143 | −3524 | 1724 | −765 | −2381 | −1379 | −3166 | 530 | −1083 | 189 | −3593 | −2828 | −460 | 678 | −1962 | −149 | 2517 | 2993 | 280 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 246 | 215 | −2954 | 602 | −1288 | 2040 | −2860 | −1545 | −2829 | −1194 | −2925 | −2087 | −1567 | 985 | −1141 | 1847 | 924 | −547 | −2516 | −3225 | 938 | 281 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 247 | −437 | 1122 | −109 | −3580 | −1811 | −3538 | −2402 | 622 | 941 | 1904 | 804 | −3136 | −482 | −2858 | −3059 | −2617 | −1946 | 1185 | −2312 | −1966 | 282 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 248 | 431 | −3258 | 1875 | −119 | −3578 | −2762 | −1421 | −3328 | 760 | 240 | 464 | 193 | 467 | 253 | −184 | −398 | −261 | −2879 | −3442 | 543 | 283 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 249 | −1793 | 837 | 1857 | 1010 | −3538 | 372 | −1432 | −3278 | 107 | −1221 | −2324 | −1412 | −2864 | −976 | 542 | 1152 | −1732 | 757 | −3423 | −2749 | 284 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 250 | 117 | −3186 | −1675 | 402 | −3474 | −753 | −1444 | −249 | 1047 | −3188 | −2284 | 203 | 1831 | −995 | −1540 | 828 | 341 | 688 | −3390 | −2728 | 285 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −3 | −9479 | −10521 | −894 | −1115 | −701 | −1378 | * | * | | | | | | | | | | | | |
| 251 | 770 | −3155 | −34 | 1110 | −3429 | −2791 | −1456 | 730 | −1057 | −3151 | 206 | −1446 | 522 | 459 | −1556 | 1934 | −1739 | −2752 | −3368 | 65 | 286 |
| — | * | * | * | * | * | * | * | * | * | * | * | * | * | * | * | * | * | * | * | * | |
| — | * | * | * | * | * | * | * | * | 0 | | | | | | | | | | | | |
| // | | | | | | | | | | | | | | | | | | | | | |

SEQUENCE LISTING (1358 sequences)

SEQ ID NO: 1 - DNA, 1926 bp, Zea mays
atggtgcagcttttgccggcgctggtggcgctcgcccttctcctcgtcagaccggtggcggatgcggcgatggctaaatacacgttcacagtggggagcatgcagatcagtcagctgtgcagcagcaccagcattattgcggtgaacgggcagctgccgggcccgtcgatagaagtgaacgaaggcgacgatgtcgtcgtcaaggtcgtcaacaactcgccgtacaacgtgaccatccactggcatggtgtgctccagctcatgaccccgtgggcggacggcccgagcatggtgacgcagtgccccatccagcccagcagctcctacacgtaccggttcagcgtgccggggcaggagggcacgctgtggtggcacgcgcactcctccttcctccgcgccacggtgtacggcgccttcatcatccgcccgaggcgcggcaacgcctaccctttcccggcgccggacaaggaggtccccatcgtgctcggcgagtggtggaaccgcaatgtagtcgacgtcgagagcgacgccatcttggccggtcagcttcccgcccagtccgacgcgttcacagttaacggcaaaaccggcctgctgtaccagtgcgcgaacgagacgttcacggcggtggtggagcccagcacgagggtgctcctccgggtcgtcaacgccggcctcaactcgcacctcttcttcaagctggccggccacaacttcaccgtcgtcgccgtggacgcgggctacacctccaacctcaacacggacacgctcgtgctcgcgccgggccagaccgtggacgcgctcgtcaccaccgccgccgcgcccgggagctactacatggcggtgctggcgcacgacaccatgagcccgctcgcgttcgcggcgtcggacacgaccaccgccaccgcgatcctccagtacaacggcacgtcgtccaccaacccgcccgcgatgcccgccatgccgtccagctccgactccgggacggccaacgccttctacttcgggctgaggggcctgggcgcgcccgcggtgccggcgccggtggacgtgagcatgaccatcgagctgggcctcggccagctgccctgcgacccgtcgcagaccaggtgcaacgggaccgcggccgccgccgcgatgaacggcgtctcgttccgcctcccgtcccccgagacgtctctcctcggggcgcacgtcgacggcgtcgcgggggtcttcacggcagatttcccggacggtccgccgccgagcggcacggcgatgtcggtggggaccaagctcaagaagctcagctacaactcggtggtggagatcgtgctgcagaacccggcggccgtcccgacggagaaccacccgatccacctccacggcttcaacttcttcgtgctggcgcaggggatgggtaccttcgccccgggaagcgtggcctacaacctggtggacccggtggcccgcaacaccatcgccgtgcctggcggtggctgggctgtcatacgcttcgtcgccaacaatccaggcatgtggttctttcactgccacctggacccgcacgtgcctatgggcctgggcatggtgttccaggtggacagcgggacgacgcccggctccacgctccctacgccgccgggggattgggtgggagtatgcgacgcgcagcactacgcggccgcggcggcggtagcagcagcgccggtgccagttccggccccagccccagtcccagcaccaatcctagcgccagcaccagcagaatcgccgttgccacctccgcgcgcggtggaccacaagccgtcgcccaaccttcctcagcgcagggagcacacgggtacctctaattccgctgctggacggagagctaaggggcacctcgcttgtttcttgtgttctgtcctccttttctttcttcttcgtcaacacaaggcctag

SEQ ID NO: 2 - DNA, 513 bp, Anabaena
atgtcaaagaaaattggtttattctacggtactcaaactggtaaaactgaatcagtagcagaaatcattcgagacgagtttggtaatgatgtggtgacattacacgatgtttcccaggcagaagtaactgacttgaatgattatcaatatttgattattggctgtcctacttggaatattggcgaactgcaaagcgattgggaaggactctattcagaactggatgatgtagattttaatggtaaattggttgcctactttgggactggtgaccaaataggttacgcagataattttcaggatgcgatcggtattttggaagaaaaaatttctcaacgtggtggtaaaactgtcggctattggtcaactgatggatatgattttaatgattccaaggcactaagaaatggcaagtttgtaggactagctcttgatgaagataatcaatctgacttaacagacgatcgcatcaaaagttgggttgctcaattaaagtctgaatttggtttgtaa

SEQ ID NO: 3 - DNA, 2553 bp, Zea mays
atgaagcagcgcctcctcgtcgtggccaaccgcctgcctgtgtccgccaaccgccgcggcgaggaccactggtcgcttgagatcagcgccggcggcctcgtgagcgccctacttggcgtgaaggacgtcgacgcgaaatggattggctgggcgggtgtcaacgtaccagatgagattggccagcgagccctcaccaaagctcttgcggagaagaggtgcataccggtgttcctggacgaggagattgtgcaccagtactacaatgggtactgcaacaacatcctgtggccgctgttccactatctaggactgccacaggaggacaggctggcaacaacgaggaactttgagtcgcagttcgacgcgtataagcgtgctaaccagatgttcgctgatgtcgtgtaccagcactaccaggagggggatgtaatctggtgtcatgactaccacctcatgttcctgcccaagtgcctcaaggaccatgacatcaatatgaaggtcgggtggttcctgcacacaccattcccgtcatcagagatttaccggacacttccgtcccgcttggagctgcttcggtcggtgctatgtgctgatttagttggattccatacttacgactatgcgaggcattttgtgagtgcttgcactagaatacttggacttgagggcacccctgagggcgtggaagatcaaggaagactaaccagggttgcagcgtttcctattgggatagactctgatcgtttcaagcgagcattggagcttccggcagtaaaaaggcacatcaatgaactgacacaacgttttgccggtcgaaaggtaatgcttggtgttgatcgacttgacatgattaagggaattccacaaaagattctggcctttgaaaagtttcttgaggaaaatccagattggaacgacaaagttgttctactgcagattgctgtgccaacaagaactgacgtccctgagtatcaaaagctcacgagccaagtgcatgaaattgttgggcgcataaatggtcgattcggaacgctgactgctgtccctattcatcatttggaccggtctcttgatttccacgccttatgtgctctttatgcagtcactgatgttgctcttgtaacatcactgagagatgggatgaaccttgtgagctacgagtatgttgcatgccaagggtctaagaaaggagttctgatacttagtgagtttgctggggcagcacaatcccttggagctggcgccattctagtaaacccttggaatattacagaggttgcagactcaatacatcatgctttaacgatgccatccgacgagagagagaaacgacacagacacaactatgctcatgtcacaactcacacggctcaagattgggctgaaacttttgtatttgagctaaatgacacggttgctgaagctctactgaggacaagacaagttcctcctggtcttcctggtcaaacggcaatccagcaatatttgcgctctaaaaatcgtctgctcatattgggtttcaattcaacattgactgagccagtcgaatcctccgggagaaggggtggtgaccaaatcaaggaaatggaactcaagttgcatcctgacttaaagggtcctctgggagccctctgtgaggatgagcgcactacagttattgttcttagtggcagtgacaggagtgttcttgatgaaaattttggagaattcaaaatgtggttggcagcagagcatgggatgtttttacgcccgacttatggagaatggatgacaacaatgcctgagcatctgaacatggattgggtagacagcgtaaagcatgttttcgaatactttacagaaagaaccccaagatcccattttgaacatcgtgaaacatcatttgtgtggaactacaagtatgctgatgttgaatttggaaggctacaagcaagagatatgctgcagcacttgtggacaggcccgatctcaaatgcagctgttgatgttgttcaagggagtcggtcagttgaagtccggtctgttggagttacaaagggtgctgcaattgatcgtattttaggggagatagttcacagcgaaaacatgattactccaattgattatgtcctgtgtatagggcatttccttgggaaggatgaggacatctatgtcttttttgatcccgaatacccttctgaatccaaagtaaaaccagagggtgggtcagcatcacttgaccggaggccaaatggaaggccggcatcgaatggcagaagcaattcaaggaacccgcagtccaggccacagaaggcgcagcaggctgcatccgagaggtcgtcctcatcaagtcacagcagcactagcagcaaccacgactggcgcgaagggtcctcggtcctcgatctcaaggccgagaactacttctcctgcgccgtcggaaggaagcggtccaacgcccgttacctgctgagttcgtcagaggaggtcgtctccttcctcaaagagttggcaacggaaacagctggcttccagtccagctgtgctgattacatgttcttggataggcagtaa

SEQ ID NO: 4 - DNA, 2736 bp, Zea mays
atgtcgcggtcgtataccaacctgctcgacctcgcggagggcaacttcgcggcgctgggcccggccggcggcagcgggcggcagagacatgggtcgttcgggctgcggcggatgtcgcgggtgatgacggtgccggggacgctgtcggagctcgacggcgaggacgagtcggagccggccgcgaccagcagcgtcgcctccgacgtgccctcgtcggtggcggtggaccgcctcatagtggtctcgaatcagttgcccatcgtcgcgcgccgcaggcccgacggccgagggtggtccttctcgtgggacggcgactcgctcctactccagctccgcgacggcattcccgacgagatggaggtgctcttcgtcggatcgctccgcgccgacgtccccgcagccgagcaggacgaggtgtcgcagacgctgctcgaccgattccgctgcgcgccggtgttcctccctgaccacctcaacgaccggttctaccacggcttctgcaagcgccagctctggcctctgttccactacatgctccccttctcatcgcccgcttccgcgtccgccgccgctacctcttcctccgtcgccacttcgtcacccggcaacggtcgcttcgaccgcagcgcttgggaggcgtacgtgctcgccaacaagttcttcttcgagaaggtcgtggaggtaatcaacccggaggatgactacgtctgggttcacgactaccatctcctggcgctgcctacctttctccgccgccgcttcaaccgcctccgcatcggattcttcctccacagccccttcccctcgtccgagatctaccgcaccctccctgttcgcgacgagatactgaaggcgctgctcaattgtgacctcattgggttccacacttttgattacgccaggcacttcctctcgtgctgcagtaggatgctgggaattgaataccagtcaaagcgtgggcacattggattggattactttggccgcactgtagggatcaagatcatgccagtgggagttcatatgggtcagttggagtcgggtctgcgcttgcctgatagggagtggaggctttctgagcttcaacagcagtttcagggcaaaactgtcttgcttggtgtggatgatatggatatctttaaggggatcaatttgaagcttcttgcatttgagaacatgttgagaacacatcccaagtggcaggggagagcagtgttagtgcagattgctaacccagcccgtggaaggggtaaggatctggaagccatccaggctgagattgaggagagctgccagaggatcaatggagactttggccagtcagggtatagccctgttgttttcatcgatcgtgatgtgtcaagtgtcgagaagattgcctattatacgatagcggaatgcgtggttgtgactgctgtgagggatgggatgaacttgacaccatatgagtacattgtctgtaggcagggtgcaccaggatctgagtcagtatcagaggtgggtgggccaaagaagagcatgctggttgtgtcagagtttattggctgctcgccgtcactgagtggtgctattagggtcaatccatggaatatagaggcaacagcagaggcgatgaatgaggccatttcaatgccagaacaggaaaaacagttgaggcatgagaaacattaccgttatgtcagcagccatgatgttgcttattggtcaaagagcttcatcctagacttggaaagggcttgtagggaccactttaagaggacatgttggggcatagggttgggttttggtttcagggtggtggccttggacgctcatttcagaaagcttaacatggattcaattgttaatgcttatgagatttcagggagcagggctatattgcttgattatgatggaacactggttcctcaaacttcaatcaacaaggaacctagtccagaggttttgaacatcatcaataccctttgctcagatagtagaaacatcgtttttcttgtcagtggtagagacaaagatatgttaggaaagtggttctcctcatgtccaaaattggggattgcagctgaacatggttacttcttgaggtggtctagcgaagaagagtggcaaacatgcactcaggccatggactttggatggatgcaaatggcaaagccagtgatgaatttgtatacagaagcaactgatggatcctacattgagacaaaagaaagtgccttggtgtggcaccatcaggatgctgacccaggctttggatcctcacaggcaaaggagctgcttgatcacctggaaagtgtactagcaaatgaaccagtctctgtcaagagtggccagttcatcgttgaagtcaaaccacagggagtaagcaagggaatagttgccgagaggatacttgcatcagtgaaggagaggggaaagcaggctgatttcgtattgtgcatcggcgatgataggtccgatgaggacatgtttgaaaatattgccgatatcattaagaggaatatggttgctccaagaacatcattgtttgcatgcactgtgggacaaaaaccaagcaaagccaaattctacctggacgatacatttgaagtggtcgctatgctgagcgcacttgcagatgccactggagctgaactggaatctgattcggctgatgaattggccgcatctatctcatcacttgatattggtgacgaacaatcagaaaccagtgatacaccaattggagggtcttag

SEQ ID NO: 5 - DNA, 1386 bp, Lycopersicon esculentum
atgagctctaaggccctagactacgagaaccttaacgagaacgtgaagaagtgccagtacgccgttaggggtgagctctacctgagggctagcgagctccagaaggagggtaagaagatcattttcactaacgtgggtaacccccacgccctcggccagaagcccctcaccttcccccgccaggtgatcgccctctgccaggcccccttcctcctggacgatcccaacgtgggcctcatcttccccgccgacgccatcgcccgcgccaagcagttcctcggcatgacctccggcggtctcggcgcctactccgactcccgcggcatccccggcgtgaggaaggaggtggccgagttcatcgagcgcagggacggctacccctccgaccccgagctcatcttcctcaccgacggcgctagccctgtgcctcagtaccctctctactccgctagcatccagctcctgggcggtagcctggtgccttactatctggaggaaaccgctaactggggcctggacatcaacgacctgcgccagtccgtggctcaggctaggtacaagggcatcaccgtccgcgctatggtcatcattaaccctggcaaccctaccggccagtgcctgtccgtcgctaacctgaagcagatcattcagttctgccaccaggagaacctggtcctgcttggtgacgaggtctaccagcaaaacatctaccaggacgagaggcctttcatcagcgcgcgtaaggtcctgcttgatatgggtctgccgctgtctaaggaggtccagcttgtctctttccacaccgtctctaagggttactggggtgagtgcggtcagcgtgggggatacttcgagatgactaacatcccgccaaaggcggtcgaggaaatctacaaggtcgcgtctatctctctttcgccgaatgttccggggcaaattttcatggggcttatggttaatccgccaaagccgggggatatttcgtacgatcaatatgttcgtgagtcgaaggggattcttgagtcgcttcggaagcgggcgcacatgatgactgatgggttcaatagttgccggaatgttgtatgtaatttcactgagggggcgatgtatagttttccgcaaattagacttccgccaaaggcgattgagacggcaaataagttggggaaggcaccagatgttttgtattgtttgagattgctagaggcaacgggaataagtacggttccaggatcaggatttggacaaaaggagggagtatttcatttaagaacaacaatattgccagcagaggaagatatgccagcaataatggaatcatttaaaaaatttaatgatgaatttatggaaaaatatgaagatcataaaggatattcacgaatgtga

SEQ ID NO: 6 - DNA, 1386 bp, Lycopersicon esculentum; identical to SEQ ID NO: 5

SEQ ID NO: 7 - DNA, 597 bp, Zea mays
atggcagctgcggcggcgccgaggcccaagtcgccgcctgcctcgccggacccctgcggccgccaccgcctccagctcgccgtcgacgcgctccaccgggagatcggcttcctcgagggcgaaataagttccatcgagggggtccacgctgcctccagatgctgcaaagaggttgatgagttcgttggaaggaacccggatccgttcctaacgattcagcaagagagaggaagccacgatcaatctcagcagtttctgaagaagttccgaggaaagagctgcctgagctactacctctcgtggatctgcggtggcgggtggtggtgcccgccgccgttgcagctcaagaggccaccggcgccgagctgctcctgcgcgccgcggctggggaagctctgctcctccaccgcctcctcctgctgcagctgttgctgctgccggttccgcgtcgtgtacgccgccgccggctgcgggtgctgcgcgccgtgcccgcgctgctcgtgcgactgcacctgcgcctgcccgcgctgctgctcctgcgcctgccccatgtgcagcgccgcgtgctgcgccccgcgctgctgcctgtgcctatga

SEQ ID NO: 8 - DNA, 597 bp, Zea mays; identical to SEQ ID NO: 7

SEQ ID NO: 9 - DNA, 596 bp, Zea mays
atgtacatgaagagtcgcctcaggttctctcttcggactgtcgccatatccacgatgtccttgctgtccgtgtatatccacagggtaatccgtactggacaatgatgcatacaaactcatacaagtatggatactctggttctgggaactattacagttatgctcatgcctatgacattgacgattacatgcatagaactgatggtgggcgcaaagtactgcgatcgcgttaacgctttatcacgataccttctaccacatatcactaacaacatcaacactcatcactctcgacgacatccactcgatcactactctcacacgaccgattaactcctcatccacgcggccgcctgcaggagctgcgcccaccatcagttctatgcatgtaatcgtcaatgtcataggcatgagcataactgtaatagttcccagaaccagagtatccatacttgtatgagtttgtatgcatcattgtccagtacggattaccctgtggatatacacggacagcaaggacatcgtggatatggcgacagtccgaagagagaacctgaggcgactcttcatgtacatagacaagctgcccaccgtag

SEQ ID NO: 10 - DNA, 2538 bp, Zea mays
atgcaggagcagcgcgcgtacggcaatgcgtgcatcggccttggcctgggtgggtggtccggccgtccgggtgggggcgccatccgtagccagccactcgcccgtgaaagcttttacttctacggaaagaaccgaggcgcggcccgcgggcgccaacctgttcccacccagaggagaggagtggtcaagtccgaggccacctgcccaggctcagacctcccccgccacaacgcgagccgcatcgcctcgtctcctccacgccatacacgcccgccttcccttccccggcgaccaggacccctcgcccgcggcgccagcgagctcccccggccagtcgtaggcctcccggagctcagcacgcacgcaggtgggtccagtgaggcctggttgtgcgcgttcctgcgggcgtcgtcggggcagatccatggaactcagccgcccgcagcgcggatagtactgcacttgtgcaccagccaccagcggatcgccaggaccgcccacctgctgctgcttgtgtcgctagccatttttcgggcgtctggcttggaggatatggccgcggcgatggacgcgcccaaccctggagcggctgctggcccaggaatgcctagtgacgccctgtaccaggagctgtggcatgcgtgtgctggcccgttggtcacagtacctagacaaggcgagcgtgtctattacttccctcagggccatatggagcagctcgaggcgtctgcacaccaccagcagcttgatcagtacttaccgatgttcgatctaccacccaagatcctatgcagagtagtcaacgtggaactacgggccgaagctgattcagatgaagtttatgctcaaattatgttgcagccagaagctgatcaaaatgaactcaccagcctggacgctgaaccacaagaacgtgaaaaatgcactgcccattccttctgcaagacactgacagcttcagatacgagcactcacggcgggttttctgttcttcggaggcatgctgaggaatgtcttcctcagctggacatgtctcaaaatccaccttgccaagaactggttgccaaagatctccatggcactgaatggcattttcggcacatttttcgagggcaacccaagaggcatctccttaccaccggctggagtgtctttgttagctcaaaaagattggtttctggggatgcattcatcttcatgagaggtgaaaatggtgagctacgggttggtgtaaggaggctcatgagacaagtaaatagcatgccgtcatctgtcatatcaagccacagcatgcatcttggagtattggccacagcctcccatgccatctccactggaaccctcttttctgttttctacaaaccaagaactagtcgctctgattttattgtgagtgtgaacaagtaccttgaagctaagaagcagaaaatatctgttggaatgaggtttaagatgagatttgaaggtgatgatgctcctgaaagaaggttcagcggaacaatcattggcatcgggagtttgccggcaatgtcaaaatctctgtgggcagattctgactggagatctctaaaggttcaatgggatgaaccttcatccattcttcgtccagatagaatctcaccatgggaagtggagccactggatgcagctaatccacaatcccctcaacctccactaagggctaagcgtccacgacccccagcttcaccttgtatggtttcggaactgccttcaggttttggactctggaaatccccaattgaatcatcctgtacactctcattttcggaacctcaacgggctcgagagttatttccttcaatccccacgtcaaccttgtcatcttcatcaaatgtcagttttaattcaaagaatgagccgtccatgctaaccagtcagttctactggtcagcaaggcatacaagagctgactcctgcgctgctagcaccaacacagtcgtaattgaaaagaagcaagagccaagttctggtggttgtagattgtttggaattaatatatgctcagctgaggaagaagtattacctgaggttactgctccaggtgttggttatgagcagactgctgcctctgtagagttgaactcggataagctctcacagccatctgatgtcaacaattctgatgccctagcagctagcagtgaacgttcacctcttgaatcccaaagccggcaagtgaggagctgtaccaaggtaattatgcaaggaatggcagtaggaagggctgtagacctgacaaagcttagtggctacagcgatctttgccagaagctggaggagatgtttgacatccagggggagctgggttccacactaaagaaatggcgggtcattttcactgatgatgaggatgacatgatgcttgttggagatgatccttgggatgagttttgcaggatggtgaaaaggatttacatttacacatacgaggaggcaaagaagctgacatccaagtcaaagttaccggttagcagtgacagcagcaagctgagcgctgcgaactcactgtctgaatga

SEQ ID NO: 11 - protein, 641 aa, Zea mays
MVQLLPALVALALLLVRPVADAAMAKYTFTVGSMQISQLCSSTSIIAVNGQLPGPSIEVNEGDDVVVKVVNNSPYNVTIHWHGVLQLMTPWADGPSMVTQCPIQPSSSYTYRFSVPGQEGTLWWHAHSSFLRATVYGAFIIRPRRGNAYPFPAPDKEVPIVLGEWWNRNVVDVESDAILAGQLPAQSDAFTVNGKTGLLYQCANETFTAVVEPSTRVLLRVVNAGLNSHLFFKLAGHNFTVVAVDAGYTSNLNTDTLVLAPGQTVDALVTTAAAPGSYYMAVLAHDTMSPLAFAASDTTTATAILQYNGTSSTNPPAMPAMPSSSDSGTANAFYFGLRGLGAPAVPAPVDVSMTIELGLGQLPCDPSQTRCNGTAAAAAMNGVSFRLPSPETSLLGAHVDGVAGVFTADFPDGPPPSGTAMSVGTKLKKLSYNSVVEIVLQNPAAVPTENHPIHLHGFNFFVLAQGMGTFAPGSVAYNLVDPVARNTIAVPGGGWAVIRFVANNPGMWFFHCHLDPHVPMGLGMVFQVDSGTTPGSTLPTPPGDWVGVCDAQHYAAAAAVAAAPVPVPAPAPVPAPILAPAPAESPLPPPRAVDHKPSPNLPQRREHTGTSNSAAGRRAKGHLACFLCSVLLFFLLRQHKA

SEQ ID NO: 12 - protein, 170 aa, Anabaena
MSKKIGLFYGTQTGKTESVAEIIRDEFGNDVVTLHDVSQAEVTDLNDYQYLIIGCPTWNIGELQSDWEGLYSELDDVDFNGKLVAYFGTGDQIGYADNFQDAIGILEEKISQRGGKTVGYWSTDGYDFNDSKALRNGKFVGLALDEDNQSDLTDDRIKSWVAQLKSEFGL

SEQ ID NO: 13 - protein, 850 aa, Zea mays
MKQRLLVVANRLPVSANRRGEDHWSLEISAGGLVSALLGVKDVDAKWIGWAGVNVPDEIGQRALTKALAEKRCIPVFLDEEIVHQYYNGYCNNILWPLFHYLGLPQEDRLATTRNFESQFDAYKRANQMFADVVYQHYQEGDVIWCHDYHLMFLPKCLKDHDINMKVGWFLHTPFPSSEIYRTLPSRLELLRSVLCADLVGFHTYDYARHFVSACTRILGLEGTPEGVEDQGRLTRVAAFPIGIDSDRFKRALELPAVKRHINELTQRFAGRKVMLGVDRLDMIKGIPQKILAFEKFLEENPDWNDKVVLLQIAVPTRTDVPEYQKLTSQVHEIVGRINGRFGTLTAVPIHHLDRSLDFHALCALYAVTDVALVTSLRDGMNLVSYEYVACQGSKKGVLILSEFAGAAQSLGAGAILVNPWNITEVADSIHHALTMPSDEREKRHRHNYAHVTTHTAQDWAETFVFELNDTVAEALLRTRQVPPGLPGQTAIQQYLRSKNRLLILGFNSTLTEPVESSGRRGGDQIKEMELKLHPDLKGPLGALCEDERTTVIVLSGSDRSVLDENFGEFKMWLAAEHGMFLRPTYGEWMTTMPEHLNMDWVDSVKHVFEYFTERTPRSHFEHRETSFVWNYKYADVEFGRLQARDMLQHLWTGPISNAAVDVVQGSRSVEVRSVGVTKGAAIDRILGEIVHSENMITPIDYVLCIGHFLGKDEDIYVFFDPEYPSESKVKPEGGSASLDRRPNGRPASNGRSNSRNPQSRPQKAQQAASERSSSSSHSSTSSNHDWREGSSVLDLKAENYFSCAVGRKRSNARYLLSSSEEVVSFLKELATETAGFQSSCADYMFLDRQ

SEQ ID NO: 14 - protein, 911 aa, Zea mays
MSRSYTNLLDLAEGNFAALGPAGGSGRQRHGSFGLRRMSRVMTVPGTLSELDGEDESEPAATSSVASDVPSSVAVDRLIVVSNQLPIVARRRPDGRGWSFSWDGDSLLLQLRDGIPDEMEVLFVGSLRADVPAAEQDEVSQTLLDRFRCAPVFLPDHLNDRFYHGFCKRQLWPLFHYMLPFSSPASASAAATSSSVATSSPGNGRFDRSAWEAYVLANKFFFEKVVEVINPEDDYVWVHDYHLLALPTFLRRRFNRLRIGFFLHSPFPSSEIYRTLPVRDEILKALLNCDLIGFHTFDYARHFLSCCSRMLGIEYQSKRGHIGLDYFGRTVGIKIMPVGVHMGQLESGLRLPDREWRLSELQQQFQGKTVLLGVDDMDIFKGINLKLLAFENMLRTHPKWQGRAVLVQIANPARGRGKDLEAIQAEIEESCQRINGDFGQSGYSPVVFIDRDVSSVEKIAYYTIAECVVVTAVRDGMNLTPYEYIVCRQGAPGSESVSEVGGPKKSMLVVSEFIGCSPSLSGAIRVNPWNIEATAEAMNEAISMPEQEKQLRHEKHYRYVSSHDVAYWSKSFILDLERACRDHFKRTCWGIGLGFGFRVVALDAHFRKLNMDSIVNAYEISGSRAILLDYDGTLVPQTSINKEPSPEVLNIINTLCSDSRNIVFLVSGRDKDMLGKWFSSCPKLGIAAEHGYFLRWSSEEEWQTCTQAMDFGWMQMAKPVMNLYTEATDGSYIETKESALVWHHQDADPGFGSSQAKELLDHLESVLANEPVSVKSGQFIVEVKPQGVSKGIVAERILASVKERGKQADFVLCIGDDRSDEDMFENIADIIKRNMVAPRTSLFACTVGQKPSKAKFYLDDTFEVVAMLSALADATGAELESDSADELAASISSLDIGDEQSETSDTPIGGS

SEQ ID NO: 15 - protein, 461 aa, Lycopersicon esculentum
MSSKALDYENLNENVKKCQYAVRGELYLRASELQKEGKKIIFTNVGNPHALGQKPLTFPRQVIALCQAPFLLDDPNVGLIFPADAIARAKQFLGMTSGGLGAYSDSRGIPGVRKEVAEFIERRDGYPSDPELIFLTDGASPVPQYPLYSASIQLLGGSLVPYYLEETANWGLDINDLRQSVAQARYKGITVRAMVIINPGNPTGQCLSVANLKQIIQFCHQENLVLLGDEVYQQNIYQDERPFISARKVLLDMGLPLSKEVQLVSFHTVSKGYWGECGQRGGYFEMTNIPPKAVEEIYKVASISLSPNVPGQIFMGLMVNPPKPGDISYDQYVRESKGILESLRKRAHMMTDGFNSCRNVVCNFTEGAMYSFPQIRLPPKAIETANKLGKAPDVLYCLRLLEATGISTVPGSGFGQKEGVFHLRTTILPAEEDMPAIMESFKKFNDEFMEKYEDHKGYSRM

SEQ ID NO: 16 - protein, 461 aa, Lycopersicon esculentum; identical to SEQ ID NO: 15

SEQ ID NO: 17 - protein, 198 aa, Zea mays
MAAAAAPRPKSPPASPDPCGRHRLQLAVDALHREIGFLEGEISSIEGVHAASRCCKEVDEFVGRNPDPFLTIQQERGSHDQSQQFLKKFRGKSCLSYYLSWICGGGWWCPPPLQLKRPPAPSCSCAPRLGKLCSSTASSCCSCCCCRFRVVYAAAGCGCCAPCPRCSCDCTCACPRCCSCACPMCSAACCAPRCCLCL

SEQ ID NO: 18 - protein, 198 aa, Zea mays; identical to SEQ ID NO: 17

SEQ ID NO: 19 - protein, 76 aa, Zea mays
VHEESPQVLSSDCRHIHDVLAVRVYPQGNPYWTMMHTNSYKYGYSGSGNYYSYAHAYDIDDYMHRTDGGRKVLRSR

SEQ ID NO: 20 - protein, 845 aa, Zea mays
MQEQRAYGNACIGLGLGGWSGRPGGGAIRSQPLARESFYFYGKNRGAARGRQPVPTQRRGVVKSEATCPGSDLPRHNASRIASSPPRHTRPPSLPRRPGPLARGASELPRPVVGLPELSTHAGGSSEAWLCAFLRASSGQIHGTQPPAARIVLHLCTSHQRIARTAHLLLLVSLAIFRASGLEDMAAAMDAPNPGAAAGPGMPSDALYQELWHACAGPLVTVPRQGERVYYFPQGHMEQLEASAHHQQLDQYLPMFDLPPKILCRVVNVELRAEADSDEVYAQIMLQPEADQNELTSLDAEPQEREKCTAHSFCKTLTASDTSTHGGFSVLRRHAEECLPQLDMSQNPPCQELVAKDLHGTEWHFRHIFRGQPKRHLLTTGWSVFVSSKRLVSGDAFIFMRGENGELRVGVRRLMRQVNSMPSSVISSHSMHLGVLATASHAISTGTLFSVFYKPRTSRSDFIVSVNKYLEAKKQKISVGMRFKMRFEGDDAPERRFSGTIIGIGSLPAMSKSLWADSDWRSLKVQWDEPSSILRPDRISPWEVEPLDAANPQSPQPPLRAKRPRPPASPCMVSELPSGFGLWKSPIESSCTLSFSEPQRARELFPSIPTSTLSSSSNVSFNSKNEPSMLTSQFYWSARHTRADSCAASTNTVVIEKKQEPSSGGCRLFGINICSAEEEVLPEVTAPGVGYEQTAASVELNSDKLSQPSDVNNSDALAASSERSPLESQSRQVRSCTKVIMQGMAVGRAVDLTKLSGYSDLCQKLEEMFDIQGELGSTLKKWRVIFTDDEDDMMLVGDDPWDEFCRMVKRIYIYTYEEAKKLTSKSKLPVSSDSSKLSAANSLSE

SEQ ID NO: 21 - protein, 404 aa, Lactococcus lactis subsp. lactis Il1403
MRKFEKSHKLDNVSYDIRGPVLDEAQRMRANGEKILRLNTGNPAEFGFLAPDEVISDLIQHAVDSEGYSDSKGIFSARKAIMQYCQLKGFPNLDINDIFTGNGVSELIVMAMQGLLDTGDEVLIPMPDYPLWTASVSLAGGTAVHYLCDEQAGWFPDIDDIRSKITSNTKAIVLINPNNPTGALYSKDLLLEIVQVARENNLIIFSDEIYDRLVMDGAVHVPIASLAPDLFVVTMNGLSKSHRIAGFRVGWMVLSGEKSHVKGYIEGLNMLASMRLCSNVLAQSVVQTSLGGTQSVDKLLLPGGRVYEQREFIYKAINDIPGLSAVKPQAAFYIFPKIDREMYKIDNDEQFVLDFLKQEKILLVHGRGFNWKEPDHFRIVYLPRVDELAEIQEKMERFLWQYRK

SEQ ID NO: 22 - protein, 251 aa, Triticum aestivum
  misc_feature (159)..(159): Xaa can be any naturally occurring amino acid
MNGSRQMELHYINTGYPYTITESFMDFFEGLTYAQADFALADAFQDQANPYWTMMQTNSYKYGYSGAGNYYSYGHVYDMNDYMHRADSGRRIWDNPMPVNNTDSPNIVLQGAEAPHASASSTTEERIQQPVHQNSSSPQVVWQDSIDPDNMTYEELLDXLGEAVGTQSRGLSQESISALPITKFKCGLFSRKKKRRERCVICQMEYRRGDLQMALPCKHVYHASCVTKWLTINKVCPVCFAEVPGEEPKRQ

SEQ ID NO: 23 - protein, 486 aa, Burkholderia xenovorans LB400
MGRLIIVSNRVAPISEGGPAAGGLAVGVYDALKETGGMWFGWSGDVLSSGQPQIKVEERGPVTFATIALMRRDYDQYYRGFSNATLWPAFHYRADLLQYDRHDFEGYWRVNAWLAQQLVPLLREDDVIWVHDYHLIPFAQALRAAGVKNRIGFFLHIPFPASQVLLAVPPHRELVEALCSFDLLGFQTAPDLRAFCDYIVNEANGTADPSASGPLTIHAFGRTLRAAAYPIGVYPDEIAELAKAGERGKPVRTMKATLHSRKLIMSVDRLDYSKGLVERFRAFERLLEHSTAQRNKVSFLQIAPPTRADMHAYQDIRLQLEGESGRINGRFAELDWTPILYIHKQYERSVLAALFRTAHVGYVTPLRDGMNLVAKEYVSAQDPENPGVLVLSRFAGAAQELDGALIVNPVDIDGMAEALARALDMPLAERQARHRDMMVQLRENNVSVWRDNFMRDLQGVAGAKGTRNGKARAVAGKKAARETQAG

SEQ ID NO: 24 - protein, 526 aa, Coprinopsis cinerea okayama7#130
MVSLSSSFKFLSQFALFSAVLAADVYYTFDIVNANLAPDGFTRPTVVVNGQFPGTLIQANKDDVLHITVNNLLTNPLMRRSTAIHWHGLFQKKTASEDGPAGVTQCPISPGHSYTYDIPLNGQAGTHWYHSHLSSQYVDGLRGPIVIYDPTDPHLSLYDEDDENTIIQLGDWYHNPAPAIQEDYLNDITDEPVPDSGTINGVGRYRGGPAIPWARVNVVQGKRYRLRVINNSAYGSFEFSIENHELTIIEVDGINHVPKTVGGFEIYAGQRYSVVIDANKPIRNYWIRAPMDVKDDSPTLDDENIYAVLHYEGAPNANPTTRADRSPSNVLKEHELVPLDPGPPGGCGPADKIIDLQYSRDTSGTTKWKFNGVRYHSPTDNTLLNIMGGATIASDFTPSEHTLILNHNDIVEIHLHGSSNGHVHPFHLHGHAFDIIQGRSGGSNCVNPPRRDVVGLTSGTGIIRFKADNPGPWFLHCHIDWHLEAGLAVVFAEAPDEQRTGPQSQIIKQEWLDLCPIYNALSPDLQ

SEQ ID NO: 25 - protein, 665 aa, Arabidopsis thaliana
MAASNHSSGKPGGVLSDALCRELWHACAGPLVTLPREGERVYYFPEGHMEQLEASMHQGLEQQMPSFNLPSKILCKVINIQRRAEPETDEVYAQITLLPELDQSEPTSPDAPVQEPEKCTVHSFCKTLTASDTSTHGGFSVLRRHADDCLPPLDMSQQPPWQELVATDLHNSEWHFRHIFRGQPRRHLLTTGWSVFVSSKKLVAGDAFIFLRGENEELRVGVRRHMRQQTNIPSSVISSHSMHIGVLATAAHAITTGTIFSVFYKPRTSRSEFIVSVNRYLEAKTQKLSVGMRFKMRFEGEEAPEKRFSGTIVGVQENKSSVWHDSEWRSLKVQWDEPSSVFRPERVSPWELEPLVANSTPSSQPQPPQRNKRPRPPGLPSPATGPSGPVTPDGVWKSPADTPSSVPLFSPPAKAATFGHGGNKSFGVSIGSAFWPTNADSAAESFASAFNNESTEKKQTNGNVCRLFGFELVENVNVDECFSAASVSGAVAVDQPVPSNEFDSGQQSEPLNINQSDIPSGSGDPEKSSLRSPQESQSRQIRSCTKVHMQGSAVGRAIDLTRSECYEDLFKKLEEMFDIKGELLESTKKWQVVYTDDEDDMMMVGDDPWNEFCGMVRKIFIYTPEEVKKLSPKNKLAVNARMQLKADAEENGNTEGRSSSMAGSR

SEQ ID NO: 26 - protein, 543 aa, Arabidopsis thaliana
MRRFVIGQAKNLIDQSRRRQLHHHKNLSFVSLIPPFSAPSDSSSRHLSSSSSSDMSASDSSSSLPVTLDTINPKVIKCEYAVRGEIVNIAQKLQEDLKTNKDAYPFDEIIYCNIGNPQSLGQQPITFFREVLALCSYTALLDESATHGLFSSDSIERAWKILDQIPGRATGAYSHSQGIKGLRDAIADGIEARDGFPADPNDIFMTDGASPGVHMMMQLLITSEKDGILCPIPQYPLYSASIALHGGTLVPYYLDEASGWGLEISELKKQLEDARSKGITVRALAVINPGNPTGQVLSEENQRDVVNFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 27 - protein, 412 aa, Burkholderia pseudomallei K96243
MKPIQKSNKLLNVCYDIRGPVLEHAKRLEDEGHRIIKLNIGNLAPFGFDAPDEIIQDMIRNLPASSGYSDSKGVFAARKAIMHYTQQKGVHGVGLDDIYIGNGASELIVMATQALLNDGDEVLLPAPDYPLWTAAVSLSGGTPVHYVCDESNRWMPDPDDIRRKITPNTKALVVINPNNPTGALYSDALLIELIAIAREHGLIIFADEVYDKIVYDGKSHTALASLAEDVITVTFNSLSKSYRSCGYRAGWMSVAGLTAENRRRAHDYLEGLGILSSMRLCANVPGQYAIQTALGGYQSINELIMPSGRLYKQRELAYDMLTSIPGVSCVKPEAALYMFPRLDPKLYPIENDQQFILELLLRERVLLVQGTGFNWPTPDHFRVVFLPNVDDLTDSIERIARFLDGYRKRNSV

SEQ ID NO: 28 - protein, 597 aa, Magnaporthe grisea 70-15
MKSFVKSLVHLALGATALATPLKPISVSPQRFSHSLSPRQECENGPNSRQCWGKYSIDTDFYKVVPDTGVTREYWLSIEEKNDCNSDGYKRYCQTINGTSPGPLITADWGDNLVIHVTNNMQTNGTAIHWHGIHQRNTVEYDGVPGVTQCPIAPGKSLTYKFRATQYGSTWYHSHFTLQASDGMFGPMIINGPATDNYDIDMGMLFLQDHFHQSAFEGWATSASKGAPPAPENTLINGTNTFDCSGSSDPNCVGGGKKFEMVFEPGKKHLIRVVNVAADAHFEFSIDGHELTVIGADLVPIKPYKTKVVQVSIAQRYDIIVEANATPGNYWLRSGADCSPAVDPTAWRDASTAIVRYDASSTAEPTSVSDVKRSGSCGDEVPSTLVPHLPLNVGPISGMTTQTLGFSATGDDLGHNWFQWTLNSSSLVLDWSKPVLQKVFDREPIFPTPYNMVRAEKAAALANSTQWFGLVIDGSSLGIRIDHPIHLHGHDFWILSQDTTPFTNETALNTINPIRRDTANLPAGGHLAIAFELDNPGAWIVHCHIAWHASQGLSLNFVESQGSIALAMPDHDVFQQTCRDWDAVKDSMPFHQDDSGI

SEQ ID NO: 29 - protein, 249 aa, Zea mays
MTSSRQMELHYINTGFPYTITESFMDFFEGLTYAHADFALMDGFQDQGNPYWTMMHTNSYKYGYSGSGNYYSYAHAYDIDDYMHRTDGGRRTWDNTTPVNNVDSANVVLQGGEAPRTTANTTSEDCIQQVHQSPGSPQVVWQDNIDPDNMTYEELLDLGEAVGTQSRGLSQECISLLPITKYKCGFFSRKKTRRERCVICQMEYRRGNLQITLPCKHVYHASCVTRWLSINKVCPVCFAEVPGEDSLRQ

SEQ ID NO: 30 - protein, 493 aa, Rhodopseudomonas palustris CGA009
MNLVVVSNRVARASGNEPMTGGLAAALLPVVEKSGAIWVGSSGRVRDGVHREPFAEIEPLGAGALAMLDLPAAHYGGYYEGFANSALWPALHSRPDLIRVSHDDYRSYREVNAFMARALLRFRKPDTAFWIQDYHFLALGAELRQLGVQHPIGFFLHTPWPSRATIGCVPHHRELIEAMLTYDLIGFQTEEDRRNFLGYVESELGLKIDGSEVSTTHGTARCEVFAISIDADAFAQQAQKAMTHPEVSRLRKSLNGEKLVIGVDRLDYSKGLINRVKAFDKMLTDRPALQRVVSLLQIATPSRGTIEAYGNLQGDLAKLVSDVNGRLGEVDWTPIRYLNKGYRQSVLAGLYRSAHVGLVTPLQDGMNLVAKEYVAAQNPLDPGVLVLSKFAGAANELDTALQVNPHDIEGMSRVIATALAMPLTERRLRWEAMMAKLRDNSIRRWFADFLAALDQAHTANRSVGPIPLAPPPSIMMAGGRSRLAPRAAGAVLQ

SEQ ID NO: 31 - protein, 200 aa, Glycine max
  misc_feature (199)..(199): Xaa can be any naturally occurring amino acid
YDIVKFCKNEGLVLLADEVYQENIYADNKKFHSFKKIVRSLGYGEEDLPLVSYQSVSKGYYGECGKRGGYMEITGFSAPVREQIYKIASVNLCSNITGQILASLVMNPPKASDESYASYKAEKDGILASLARRAKALEVAFSKLEGITCNKAEGAMYLFPQICLPQKAIEAAKAANKAPDAFYALRLLESTGIVVVPGXG

SEQ ID NO: 32 - protein, 533 aa, Pleurotus ostreatus
MFPGARILATLTLALHLLHGTHAAIGPTGNMYIVNEDVSPDGFARSAVVARSVPATDPTPATVSIPGVLVQGNKGDNFQLNVVNQLSDTTMLKTTSIHWHGFFQAGSSWADGPAFVTQCPVASGDSFLYNFNVPDQAGTFWYHSHLSTQYCDGLRGPFVVYDPSDPHLSLYDIDNADTVITLEDWYHIVAPQNAAIPTPDSTLINGKGRYAGGPTSPLSIINVESNKRYRFRLVSMSCDPNFTFSIDGHSLLVIEADAVNIVPITVDSIQIFAGQRYSFVLTADQTVGNYWIRANPNLGSTGFDGGINSAILRYAGATEDDPTTTSSTSTPLLETNLVPLENPGAPGPAVPGGADININLAMAFDFTNFELTINGVPFIPPTAPVLLQILSGASSAASLLPSGSIYALEPNKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDDLCPIYDALSDNDKGGIVPS

SEQ ID NO: 33 - protein, 238 aa, Brassica napus
RPTRPEILNTLCRDKSNLVFIVSAKSRETLSDWFSPCEKLGIAAEHGYFLRLRKDVEWENCVAAADCSWKQIAEPVMELYTETTDGSTIEDKETALVWSYEDADPDFGSCQAKELLDHLESVLANEPVTVKRGQNYVEVKPQGVSKGLIARRMLSMMQEKGTPPEFVLCIGDDRSDEDMFEVICSSTEGPSIAPRAEVFACTVGQKPSKAKYYLDDTTEIVRLMHGLASVSEQTMSAV

SEQ ID NO: 34 - protein, 499 aa, Trametes ochracea
AIGPSANLVVTNAAVAADGHSRDAVVVNGGTPGPLITGNKGDQFQLNVINNLTNFTMLKSTSVHWHGFFQKGTNWADGPAFVNQCPIAAGSSFLYDFSTPIQAGTFWYHSHLSTQYCDGDRGPFVVYDPNDPSANLYDVDNLNTVITLTDWYHTAAQNGPAKPGGADATLINGQGRGPSSPSADLAVISVTAGKRYRFRLVSNSCDPNYTFSIDGHQMTIIQVDSINVQPLVVLKIQIYAAQRYSFILNANQAVNNYWIRANPNQGNVGFTNGINSAILRYSGAAATQPTTSQTSSVQPLDQTNLHPLTATAVPGSPVAGGVNLAINQAFNFNGTNHFVDGASFVPPTVPVLSQIVSGAQSAADLLASGLVYSLPSDANIEISFPATSAAAGGPHPFHLHGHAFAVVRSAGSTTYNYNDPIFRDTVSTGTPAANDNVTIRFKTNNPGPWFLHCHIDFHLEAGFAVVFAQDIPDVASANPTPNAWSDLCPVYDAASSSSQ

SEQ ID NO: 35 - protein, 487 aa, Triticum aestivum
MAATVAVDNLNPKVLKCEYAVRGEIVIHAQRLQQQLQTQPGSLPFDEILYCNIGNPQSLGQQPVTFFREVLALCDHPDLLKKEEIKTLFSADSISRAKQILALIPGRATGAYSHSQGIKGLRDAIASGIASRDGFPANADDIFLTDGASPGVHLMMQLLIRNEKDGILKDGILVPIPQYPLYSASIALHGGSLVPYYLNESTGWGLEISDVKKQLEDARSRGIDVRALVVINPGNPTGQVLAEENQYDIVKFCKNEGLVLLADEVYQENIYADNKKFHSFKKIVRSLGYGEEDLPLVSYQSVSKGYYGECGKRGGYMEITGFSAPVREQIYKIASVNLCSNITGQILASLVMNPPKASDESYASYKAEKDGILASLARRAKALEIAFSKLEGITCNKAEGAMYLFPQICLPQKAIEAAKAANKAPDAFYALRLLESTGIVVVPGSGFGQVPGTWHFRCTILPQEEKIPAIISRFTVFHETFMAEYRD

SEQ ID NO: 36 - protein, 176 aa, Saccharophagus degradans 2-40
MSDSNRALIGLFYGSSTCYTEMASEKIATQLGESLIDRFNIADTPIVNAQFYDFIIMGIPTWDYGELQEDWEEIWPELDDLDLTGKKVALFGLGDQIGYPEWFLDAMGYLHDKLASRGATMVGYVSTEGFEFEGSKALTPDESQFVGLALDEENEFDKTEARIAAWCEQITQEFGI

SEQ ID NO: 37 - protein, 462 aa, Arabidopsis thaliana
MSEEQPHANLAVPAFKTEKEPITQTRNGQSSVWRFGGSDKAAKASTVTLRGVIYMLFDNCGKDVNKTILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEKEWEIDLEGIEAIADENTVAMVVINPNNPCGNVYSHDHLKKVAETARKLGIMVISDEVYDRTIFGDNPFVSMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGDALGLKNWMRITIGVEAHMLEDALERLKGFCTRHAKKTETETESLQALKLSDNNLEM

SEQ ID NO: 38 - protein, 176 aa, Shigella flexneri 2a str. 301
MAIHGIFFGSDTGNTENIAKMIQKQLGKDVADVHDIAKSSKEDLEAYDILLLGIPTWYYGEAQCDWDDFFPTLEEIDFNGKLVALFGCGDQEDYAEYFCDALGTIRDIIEPRGATIDADWPTAGYHFQASKGLADDDHFVGLAIDEDRHPELTADRVEKWVKQISEELHLDEILNA

SEQ ID NO: 39 - protein, 622 aa, Arabidopsis thaliana
MSQTSLEPLIISIIKLQILQLWLKLIAVGWNLGSNDDELYTELWKACAGPLVEVPRYGERVFYFPQGHMEQLVASTNQGVVDQEIPVFNLPPKILCRVLSVTLKAEHETDEVYAQITLQPEEDQSEPTSLDPPLVEPAKPTVDSFVKILTASDTSTHGGFSVLRKHATECLPSLDMTQPTPTQELVARDLHGYEWRFKHIFRGQPRRHLLTTGWSTFVTSKRLVAGDAFVFLRGETGDLRVGVRRLAKQQSTMPASVISSQSMRLGVLATASHAVTTTTIFVVFYKPRISQFIISVNKYMMAMKNGFSLGMRYRMRFEGEESPERIFTGTIIGSGDLSSQWPASKWRSLQIQWDEPSSIQRPNKVSPWEIEPFSPSALTPTPTQQQSKSKRSRPISEITGSPVASSFLSSFSQSHESNPSVKLLFQDPATERNSNKSVFSSGLQCKITEAPVTSSCRLFGFDLTSKPASATIPHDKQLISVDSNISDSTTKCQDPNSSNSPKEQKQQTSTRSRIKVQMQGTAVGRAVDLTLLRSYDELIKELEKMFEIEGELSPKDKWAIVFTDDEGDRMLVGDDPWNEFCKMAKKLFIYPSDEVKKMRSKSLLGDKGTIVNLESDQRTVHV

SEQ ID NO: 40 - protein, 517 aa, Coriolopsis gallica
MARFQSLLTFITLSLVASVYAAIGPVADLTISNGAVSPYGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAARVGPAIPTADATLINGLGRSINTLNADLAVITVTKGKRYRFRLVSLSCDPNHTFSIDGHSLTVIEADSVNLKPHTVDSIQIFAAQRYSFVLNADQDVDNYWIRALPNSGNTNFDGGVNSAILRYDGAAPVEPTTSQAPSTNPLVESALTTLEGTAAPGSPTPGGVDLALNMAFGFAGGRFSINGASFTPPTVPVLLQILSGAQSAQDLLPTGSVYSLPANADIEISLPATTAAPGFPHPFHLHGHAFAVVRSAGSSTYNYENPVYRDVVSTGSPGDNVTIRFRTDNPGPWFLHCHIDFHLEAGFAVVMAEDIPDVAATNPVPQAWSDLCPTYDALSPDDQ

SEQ ID NO: 41 - protein, 173 aa, Triticum aestivum
  misc_feature (92)..(92): Xaa can be any naturally occurring amino acid
  misc_feature (141)..(141): Xaa can be any naturally occurring amino acid
  misc_feature (160)..(160): Xaa can be any naturally occurring amino acid
  misc_feature (166)..(166): Xaa can be any naturally occurring amino acid
PFNQIISANIGNPQQLGQKPITFFRQVLSLLEYPTLLENEDVLLKQLGYKVDVIERAKWLLKSVGAIGAYSASNGAPAIRESIANFIERRDXHPADPKDIYLSAGASSGVNTLLSIICAKPTTGVLVPIPQYPLYTATLSXLGAKCVPYYLDESKGWGTXVEAIKXAYEQGNF

SEQ ID NO: 42 - protein, 1444 aa, Arabidopsis thaliana
MDYDDARGERPRLLVVANRLPVSAKRTGENSWSLEMSPGGLVSGLLGITSQFDTKWVGWPGVDVHDEIEKNALTESLAEMKCIPVFLNGVFDQYYNGYCNGILWPILHHMGLPQEDQHDTNQTFETQYDAYKKANRMFLDVIIDNYEEGDIVWCHDYHLMFLPQYLKEYNNKIKVGWFLHSPFPSSEVYKTLPSRSELLRAILAADLLGFHTYDFARHFLSTCTRILGVEGTHEGVVYQGRVTRVAVFPIGIDPDRFIRTCKLPEVTQQMNELQEKFAGKKVILGVDRLDMIKGIPQKYLAFEKFLEENPYWRDKVVLVQIAVPTRNDVPEYRKLKSQVHGLVGRINGRFGSVSSLPIHHLDCSVDFNYLCAIYAIADVMLVTSLRDGMNLVSYEFVACQEAKKGVLVLSEFAGAGQSLGVGALIVNPWDVTEVSSAIKEALNMPAEERETRHRSNFQYVCTHSAEKWGLDFMSELNGIIPESEMQMRKIPLQLPEQDVIQQYSQSNNRLIILGFFGTLAEPMNSGTKEMDLKLNPELKGTLKALCNDPKTTVVVLSRSGKNILNKNFGESNIWLAAENGMFEKQTTGEWVTNMPQNVNLDWVDGVKNVFKYFTDRTPRSYFEASETSLVWNYEYADVEFGRAQARDLLQYLWAGPISNASVDVVRGNHSVEVHAIGETKGAAIGRILGEIVHRKSMTTPIDFVFCSGYFLEKLMGYDNVCGERQTLLVVANRLPASAKRTGEHSWSLEMSPGGKFNLLVEKDAVSKSLAEMKCIPVFLNEVFDQYYNGYSNGILWPILHHMGLPQEYDHDTIKTFETQYDAYKKANRMFLDVIKENYKDGDIVWCQDYHLMFLPQYLKEYNNKIKVGWFLHSPFPSSEIYKTLPSRSELLRSVLAADLISFHTYDFARHFVNTCTRILGVEGTHEGVVYQGRVTRVVVLPMGIYPNRFIKTCKLPEVIQQMNELKDRFSGKKVILGVDRLDMIKGIPQKYLGFEKFLDENPNWRDKIVLVQIAVPTRNEVPEYQKLKNQVHRLVGRINGRFGSVSSLPIHHMDCSVDSNYLCALYAISDVMLVTSLRDGLNLVSHEFVACQEAKRGVLILSEFAGAGQSLGAGALLVNPWNVTEVSSAIKKALNMPYEERETRHRVNFKYVKTHSAEKWGFDFLSELNDAFDESELQIRKIPHELPQQDVIQRYSLSNNRLIILNFGEYKIWLAAENGMFLKHTTEEWVTNMPQNMNLDWVDGLKNVFKYFTDRTPRSFFEASKTSLVWNYEYADVEFGRAQARDLLQYLWAGPISNASAEVVRGKYSVEVHAIGVTKEPEIGHILGEIVHKKAMTTPIDYVFCSGYFLEKDEDIYTFFESEILSPKLSHETRSKSSSSNHSLEKKVSLNVLDLKQENYFSTAIGQARTKARYVVDSSHNVVNLLHKLAVANTTTTSVKKPNV

SEQ ID NO: 43 - protein, 170 aa, Nostoc punctiforme PCC 73102
MSKKIGLFYGTQTGNTESDAEKIRDEFGGDVVTLHPIYEADTTTFDEYELLIIGSPTWDIGQLQSDWESFFSDLDEIGFSGKLVAYFGDGDQYGYADNFQDAMGILEEKISQRGGKTVGYWSTEGYEFENSRALKNGKFVGLALDEGSQSDLTDERIKTWVAQLKTEFGL

SEQ ID NO: 44 - protein, 559 aa, Melanocarpus albomyces
  misc_feature (98)..(98): Xaa can be any naturally occurring amino acid
EPTCNTPSNRACWSDGFDINTDYEVSTPDTGVTQSYVFNLTEVDNWMGPDGVVKEKVMLINGNIMGPNIVANWGDTVEVTVINNLVTNGTSIHWHGIXQKDTNLHDGANGVTECPIPPKGGQRTYRWRARQYGTSWYHSHFSAQYGNGVVGTIQINGPASLPYDIDLGVFPITDYYYRAADDLVHFTQNNAPPFSDNVLINGTAVNPNTGEGQYANVTLTPGKRHRLRILNTSTENHFQVSLVNHTMTVIAADMVPVNAMTVDSLFLAVGQRYDVVIDASRAPDNYWFNVTFGGQAACGGSLNPHPAAIFHYAGAPGGLPTDEGTPPVDHQCLDTLDVRPVVPRSVPVNSFVKRPDNTLPVALDLTGTPLFVWKVNGSDINVDWGKPIIDYILTGNTSYPVSDNIVQVDAVDQWTYWLIENDPEGPFSLPHPMHLHGHDFLVLGRSPDVPAASQQRFVFDPAVDLARLNGDNPPRRDTTMLPAGGWLLLAFRTDNPGAWLFHCHIAWHVSGGLSVDFLERPADLRQRISQEDEDDFNRVCDEWRAYWPTNPYPKIDSGL

SEQ ID NO: 45 - protein, 185 aa, Azoarcus sp. BH72
MNKIGMFFGTETGTTRLIAKKIHKKLGDEIADKPVNVNRIEPADMLKYDVLILGTPSYGIEEVPGLSAGCLEPNWAEFLVKMDKPDFSGKRIALFGLGAQERYSERFCSSLMRIYEIFKGYGAEIVGDDWPTDGYTFQQSAAVKDGRFVGLVIDERTQGMYTNERIDTWVAKVKPLLLEKLGVEA

SEQ ID NO: 46 - protein, 520 aa, Trametes versicolor
MSRFHSLLAFVVASLTAVAHAGIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAANVGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTEPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 47 - protein, 545 aa, Volvariella volvacea
MAFSSSRMQSLLNTLTVMITLMGLGVSYAAAQQSFHTLELTNDEVNPDGFQRDAVLVNGGLFGAVITGQKGDGFVIEVDNQLTDSLLRKSTSIHWHGLFQRDSAWADGPAFVTQCPIAPGHTFTYRFTATEEAGTFWYHSHLDAQYCDGLRGPFIIYGPNDPHLGLYDVDNEDTIITLADWYHTPAELLSGGISPQSTLINGLGRSSSDFTAPLAVVNVQQGLKYRMRLISISCDPNWIFSIEGHELTVIEADGISVQPVTVTSLQIFVGQRYSFVLHANQPVGNYWIRANPNKGPTGFGNNINSAILRYQGAPIADPTGAGLQDALNRLAEPNLHPVVNPGAPGLAQINGADIDIVINIGFSGGLFNIAGTSYTSPDVPSLLQILSGTPPSKCIRSRVLNDAHRGIRLAHAQRILYRVPGNKVVQLSFPVIAGQGSAIGAPHPIHLHGHAFDVIRSAGSNVYNYVDPPRRDVVSIGRAGDNVTIRFVTDNAGPWYLHCHIEWHLRSGLGVIIAEDSQGVVNGPQPPPEWEELCDIYDALIPEDQ

SEQ ID NO: 48 - protein, 175 aa, Pectobacterium atrosepticum SCRI1043
MALIGIFFGSDTGNTENIAKTIQQQLGTGVADVHDIAKSSKEDLEGFDILLLGIPTWYYGEAQCDWDDFFPSLEEVDFTGKLVALFGCGDQEDYAEYFCDAMGTIRDIIEPRGATIVGHWPTEGYYFEASKGLADDNHFIGLAIDEDRQPELTNERVTTWVKQISDELNLKELVG

SEQ ID NO: 49 - protein, 635 aa, Candida glabrata CBS 138
MMVPLLLSTYFITAVYGATHTFHWTTGWGNRNVDGIKERPVITCNGEYPWPDVRVAKGDRIEVYLTNGFNNTNTSLHFHGMFQRGTNQMDGVPYLTQCPIGPGDTMLYNFTVDENVGTYWYHSHTDGQYEDGMRGLFVIEDGENNKNFPYEYDEDVMLSIGEWYDTTVDVLTRKFLNLNNPTGAEPIPQNLILNNTMNLTWEVQPDTTYLLRIVNVGGFVSQYFWIEDHEMEVVEVDGVYVEKNTTNMLYITVAQRYAVLVHTKNDTSKNFAIMQKFDDTMLDVIPKDLQLNATSYLVYDKSKPMPEQNYVDSIDDYLDDFYLVPMDKEELYPEADHVITIDVIMDNLINGVNYAFFNNITYTTPKVPTLLTVLSAGQDALNPFIYGTNTNTFVLKKGEVVDLIVNNQDTGKHPFHLHGHVFQTILRDREFDDAKGEKPHSFNDSDHAAYPSIPMKRDTVYLNPQSNMVLRFKADNPGVWFFHCHIEWHLLQGLAVVMVEDPISIQNTASQHLTANGLQVCGNVKVPTQGNAAANDSDFFNLEGQNVQHKSIPTGFTKKGIIAMTFSCLAGVLGITMIAIYGFSEIPEPEIKVMRNLHLNPEDVLEKTSSSSVISASNSSSLEDSRNQKKKFIFF

SEQ ID NO: 50 - protein, 533 aa, Volvariella volvacea
MLSPTLVALSVLFATTAFAIGPVTELQIVNDEIAPDGFSRGSVLANGAYPGPLITGSKGDRFLINVINELTDTTMLRATSIHWHGFFQNHTAWADGVASVTQCPIVPSESFLYNFTVPDQAGTLWYHSHLSTQYCDGLRGPLVVYDPDDPHRHLYDIDDGAIMMWLNQCHPDSYVAIESTIITLSDWYHVKAPVAGLQPTPMSTLINGRGRYAGGPNVPLEVINVVPGIRYRFRLVSMVCDPNYIFSIDGHELTIIEADGVNTKPLTVDSIQIFAGQRYSFILNANQPVDNYWIRANPNLGTTGFTNGINSAILRYEGAPLQDPTTPLVSSVNPLVESNLRNLIENAVPGQPFPGGADININLFTDFDWDMLHFTVNGSPYIPPNAPVLLQILSGTYNAQDLMPAGSIIELPSNKVIEISMPGGSPGSPHPFHLHGHTFDVIRSTDTQEYNFVDPVRRDVVNTGFETDNVTIRFTTDNPGPWILHCHIDWHLEVGLAVVFAEDIPRISTPAPPPSWDELCPEYDRFPVETFDQ

SEQ ID NO: 51 - protein, 533 aa, Volvariella volvacea
MAYSARLGSALSTLAIMLLVLALGVGHATAQASPPQSVHTLNLTNANVSPDGYNRSAILVNGNLLNEAIVGNKGDQFVITVENNLDNPLLRKSASIHWHGLFQRGTQWADGPAFVTQCPIAPEHSFTYQFTAGHEAGTFWYHSHLDAQYCDGLRGPFIIYDPADPHLSLYGVDDNSTIITLADWYHEPASQLSGIVIPKSTLINGLGRANTTTDAPLAVIHVEQGVKYRFRPVALSCDPNWVFSIEGHELTVIESDGVSVQPVTVTSLQIFAGQRYSFVLHANQAVDNYWIRANPNLGPTGFADGINSAILRYNGAPDEEPTGSGLQDPSNRLHEPDLHPVANPGAPGFDEIDGVDVNLVINIGFAAGRFSMAGASFEPPSLPALLQILSGTTDVADLLPAGSYIELPANKVVQISFPVISGGGAATGAPHPIHLHGHTFDVIRSAGSSTYNFVDPPRRDVVSIGTPGDNVTIRFVTDNAGPWFLHCHIEWHLRSGLGVILAEDIPGIVSGPQPPAAWEELCDIYNDLDEEDR

SEQ ID NO: 52 - protein, 562 aa, Volvariella volvacea
MLFFSSRVKYLLGHLAVITAVVGGDVGNPGDHSGGYPGGHSEDHHGGPSGGHSGSHSDHSGSHRSFHTLKLTNGRVSPDGFQRNAVLVNGGLFQTAITGNKGDEFAIKIDNKLTNSLSHKSTSIHWHGLFQHGTPWADGPAFVSQCPIAPGHQYTYRFSSADQAGTFWYHSHLDAQYCDGLRGPFIIYDPGDPHRSLYDIDNKDTIITLADWYHRDSNLLSGIVIPNSTLINGLGRTAQSPNTPLAVVNVKQGLRYRMRLVAISCDPNWIFSIEGHKLTVIEADGVSVQPVTVTSLQIFVAQRYSFVLHANQPVGNYWIRANPNIGPTGFDSNINSAILRYKGAPIAEPRGLGLQNSDNRLREPDLHPLFNPGAPGLAHVDGADINMVINIGFIQSAGRFTIDGTSYVPPDVPTLLQILSGTPASSLLPSGSYIALPPNKVVQLSFPVFDGQGSALGGPHPIHLHGHTFDVIRSAGSSEYNFVNPPRRDVVAIGTPGDNVTIRFATDNAGPWYLHCHIEWHLRAGLGVVIAEDAPGLANGPEPPEEWKQLCPIYNALDPDDK

SEQ ID NO: 53 - protein, 508 aa, Volvariella volvacea
MGLGVGFVAAGTASHTLTLTNGVVSPDGHSREVVLVNGALFGKLITGRKGDDFEIEVDNQLTNSLLRKSTSIHWHGLFQRGSAWADGPAFVTQCPIAPGNTFTYSFTPTDEVGTFWYHSHLDAQYCDGLRGPFVIYDRFDPHRHRYDVDNKDTIITLADWYHTPAAQLSGVITPNSALINGRGRTATTTTAPLSVIRVRRGRKYRMRLISMSCDPNYIFSIEGHEMTVIEADGISVEPVTVTSLQIFVGQRYSFVLHANQPVGNYWIRANPNKGPTGFVDGINSAILRYHGAPNAEPTGAGLQDALNRLAEPDLHPIVNPGAPGLATPDGVDIDIVVNIGFAAGLFNIDGTSYVSPDIPTLLQILNGVPVGSLMPSGSYIALPANKVVQISFPVVSGQGSAIGAPHPIHLHGHAFDVVRSAGSATYNYADPPRRDVVSIGTPGDNVTIRFVTDNAGPWYLHCHIEWHLRAGLGVILAEDAPGVLTGPAPPSEWDDLCDIYDGLDEEDQ

SEQ ID NO: 54 - protein, 478 aa, Mycobacterium tuberculosis CDC1551
MVVANRLPVDLERLPDGSTTWKRSPGGLVTALEPVLRRRRGAWVGWPGVNDDGAEPDLHVLDGPIIQDELELHPVRLSTTDIAQYYEGFSNATLWPLYHDVIVKPLYHREWWDRYVDVNQRFAEAASRAAAHGATVWVQDYQLQLVPKMLRMLRPDLTIGFFLHIPFPPVELFMQMPWRTEIIQGLLGADLVGFHLPGGAQNFLILSRRLVGTDTSRGTVGVRSRFGAAVLGSRTIRVGAFPISVDSGALDHAARDRNIRRRAREIRTELGNPRKILLGVDRLDYTKGIDVRLKAFSELLAEGRVKRDDTVVVQLATPSRERVESYQTLRNDIERQVGHINGEYGEVGHPVVHYLHRPAPRDELIAFFVASDVMLVTPLRDGMNLVAKEYVACRSDLGGALVLSEFTGAAAELRHAYLVNPHDLEGVKDGIEEALNQTEEAGRRRMRSLRRQVLAHDVDRWAQSFLDALAGAHPRGQG

SEQ ID NO: 55 - protein, 727 aa, uncultured archaeon GZfos34H9
MRRLLIISNRLPVSVERRKNEFRFSSSVGGLATGLNALHQKYKSVWVGWPGIAINREETDYVESKLSEFNCYPVFLSQGEVEKYYYGFSNKTLWPLFHYFPQYAKYEHSEWSAYEHVNRKFCERVAEIAKPEDIIWIHDYHLMLLPGLIRERFPDATIGFFLHIPFPSADLFRLIPWRRRILEGVLGADLIGFHIYDYAHNFLCSVLRLLGYEHEFGKFAIGDRIVQVDVHPMGIEVQKFVRATSGRGIKREVARLRSRFKNCKIIFSMDRLDYTKGIPERLYAFEHFLETHPEWHEKVVFILKIAPSRTKVGQYRVLKQEIDELVGRINGKYGTPEWVPISYFYRSLPFQTIIAFYLAADVALLTSMRDGMNLIAKEFVASRVDGKGVLILSEMAGAARELGEALVVNSNNKEEVAEALNEALRMPDEEQKSRNEEMQKRLSHYDVFHWGSGFIRSVLETKRLQEELNMKKLSEKIREELKNSYKAADKRLLLLDYDGTLVPFADKPERAKPDRELLDLFRALSEPPENTVVIISGRDKETLERWFGDTGVCLVAEHGVWLREEEGEWKEIELLKEDWKEKIIPILDLFVDRAPGSFIEEKRFSLVWHYRKVDPELGELRAKELTDQLIDLTACTELQVMKGNKVVEVKDGRVNKGIAASHWLTKGFGFILAVGDDLTDEDMFKVLPEDAYSVKIGFTPSEARFYLGSPKEVRALLDEMEMVEVYK

SEQ ID NO: 56 - protein, 171 aa, Wolinella succinogenes DSM 1740
MNKTAIFYGSTGGNTKEAATLIHRELGGEAVADIFDVSKLKDASAFAPYENLILGTSTWGDGDLQDDWYDFLKEFEKADLGSKKVALFGLGDQEGFGHAYLNGMKTLHDSAKKLGATIVGAWEDEGYSYDSSEAVVNGKFVGLALDADNQDELTPERVKNWCAELKKALSI

SEQ ID NO: 57 - protein, 482 aa, Nicotiana glutinosa
MGFISGNKKLLSKIATSDGHGENSAYFDGWKAYENDPFHLTQNPNGVIQMGLAENQLCFDLIQEWVVNNPKASICTAEGAQDFNDIAIFQDYHGLREFRKAVSRFMEKVRGDKVTFDPDHIVMSGGATGAHETLAFCLADPGDAFLVPTPYYPGFDRDLRWRTGVQLFPVVCESFNNFKITKEALESAYEKAQESNIRVKGLLINNPSNPLGTILDRETLKDILRFINDKNIHLVCDEIYAATVFSQPDFISISEVMQEVNGCNENLVHVVYSLSKDLGFPGFRVGIIYSYNDVVVSCARKMSSFGLVSTQTQFLIASMLSDEIFVENFIAKSSVRLSQRHGFFTKGLAQVGISSLKSNSGLFFWMDLRRLLKESTFEAELDLWHIIINEVKLNVSPGVSFHCSEPGWFRVCFANMDDETMRVALRRIKHFVLQRKGLIEVATKKQCRRRRKREISLSFRRLDDFMNSPHSPMSSPMVQART

SEQ ID NO: 58 - protein, 404 aa, Lactococcus lactis subsp. lactis
  misc_feature (60)..(60): Xaa can be any naturally occurring amino acid
MRKFEKSHKLDNVSYDIRGPVLDEAQRMRANGEKILRLNTGNPAEFGFLAPDEVISDLIXHAVDSEGYSDSKGIFSARKAIMQYCQLKGFPNLDINDIFTGNGVSELIVMAMQGLLDTGDEVLIPMPDYPLWTASVSLAGGTAVHYFCDEQAGWFPDIDDIRSKITSNTKAIVLINPNNPTGALYSKDLLLEIVQVARENNLIIFSDEIYDRLVMDGAVHVPIASLAPDLFVVTMNGLSKSHRIAGFRVGWMVLSGEKSHVKGYIEGLNMLASMRLCSNVLAQSVVQTSLGGTQSVDKLLLPGGRVYEQREFIYKAINDIPGLSAVKPQAAFYIFPKIDREMYKIDNDEQFVLDFLKQEKILLVHGRGFNWKEPDHFRIVYLPRVDELAEIQEKMERFLWQYRK

SEQ ID NO: 59 - protein, 403 aa, Ralstonia eutropha JMP134
MPDSPSRHSPDPQLPLARDAVHNLRASRIREVANAGIGLPEVLPFWFGESDQVTPDFVRDAAARALAGGATFYTHNLGIAPLRSALADYVGALHGATRIENVAVTSAGVNGLMLAAQLIAGPGDRVVAVTPLWPNLVEIPKILGASVETVSLDYGPHGWTLDVDKLLAALTPDTRALMVNSPNNPTGWVMSRAAQLTVLDHCRRHGIWIIADEVYERLYYGDEPGGGDSRTAPSFLDIASREERVICVNSFSKAWLMTGWRLGWMVLPSSMTDDLGKLIEYNTSCAPSFVQEAGVAAVREGEAFTRDLVQRLRTARDHLVDALSALPGVDAHAPEGAMYVFFRLSGATDSLALCKQLVREAGLGLAPGSAFGDEGEGFVRWCYACDTDRLDEGVRRLRGFIGR

SEQ ID NO: 60 - protein, 516 aa, Coprinopsis cinerea
MQLLAFVLAALPLARAAIGPVGNLVIANANVSPDGFVRSAVLAGATGTSLEHPGPVIVGQKGDTFHINVIDDLTDPTMLRTTSIHWHGFLQEGTAWADGPAGVTQCPIAPGHSFLYKFQAKNQAGTFWYHSHHMSQYCDGLRGVMVVYDPLDPHRHLYDVDNENTIITLADWYHDPAPSAGLVPTPWSTLINGKGRYPGGPVVPLAVIHVSRGKRYRFRLVSLSCDPNYVFSIDGHTMTVIEVDGVNHEPLVVDHIQIFAGQRYSFVLNANRPVNNYWVRANPNLGSVGFGGGINSAILRYVGAPAVDPTTSQLPFSNPLLETNLHPLVNPAAPGGPSPGDVDVAINLDILFDVSILKFTVNGATFDEPPVPVLLQILSGAHTASSLLPSGSVYTLPPNKVIELTIPGGGIGAPHPIHLHGHTFKVVRSAGSSTYNFVNPVERDVVNVGQAGDNVTIRFVTDNAGPWILHCHIDWHLVLGLSVVFAEDVPTIDSSVQPPAWHDLCPIYDALPPGTR

SEQ ID NO: 61 - protein, 169 aa, Anabaena sp.
AKKIGLFYGTQTGKTESVAEIIRDEFGNDVVTLHDVSQAEVTDLNDYQYLIIGCPTLNIGELQSDWEGLYSELDDVDFNGKLVAYFGTGDQIGYADNFQDAIGILEEKISQRGGKTVGYWSTDGYDFNDSKALRNGKFVGLALDEDNQSDLTDDRIKSWVAQLKSEFGL

SEQ ID NO: 62 - protein, 163 aa, Campylobacter jejuni RM1221
MSVAVIYGSAMGNTEGAANTIASKLGISDVFNISDIDAAKMNSYDKLICGTSTWGSGDLQDDWDGFDFSGLSLGGKTVAVFGMGDSESYSDTFCGGMGKLAQNLKDAGANLVGEVSTDGYTFEASDAVVDGKFVGLALDNDNQEDQTESRIDAWIEQIKPYFA

SEQ ID NO: 63 - protein, 741 aa, Saccharomyces cerevisiae YJM789
MKNAINTAVLENIIPHRHVKWVGTVGIPTDEIPENILANISDSLKDKYDSYPVLTDDVTFKAAYKNYCKQILWPTLHYQIPDNPNSKAFEDHSWKFYRNLNQRFADAIVKIYKKGDTIWIHDYHLMLVPQMVRDVLPFAKIGFTLHVSFPSSEVFRCLAQREKILEGLTGADFVGFQTREYARHFLQTSNRLLMADVVHDEELKYNGRVVSVRFTPVGIDAFDLQSQLKDGSVMQWRQLIRERWQGKKLIVCRDQFDRIRGIHKKLLAYEKFLVENPEYVEKSTLIQICIGSSKDVELERQIMIVVDRINSLSTNISISQPVVFLHQDLDFSQYLALSSEADLFVVSSLREGMNLTCHEFIVCSEDKNAPLLLSEFTGSASLLNDGAIIINPWDTKNFSQAILKGLEMPFDKRRPQWKKLMKDIINNDSTNWIKTSLQDIHISWQFNQEGSKIFKLNTKTLMEDYQSSKKRMFVFNIAEPPSSRMISILNDMTSKGNIVYIMNSFPKPILENLYSRVQNIGLIAENGAYVSLNGVWYNIVDQVDWRNDVAKILEDKVERLPGSYYKINESMIKFHTENAEDQDRVASVIGDAITHINTVFDHRGIHAYVYKNVVSVQQVGLSLSAAQFLFRFYNSASDPLDTSSGQITNIQTPSQQNPSDQEQQPPASPTVSMNHIDFACVSGSSSPVLEPLFKLVNDEASEGQVKAGHAIVYGDATSTYAKEHVNGLNELFTIISRIIED

SEQ ID NO: 64 - protein, 470 aa, Rhodobacter sphaeroides 2.4.1
MSRLVVVSNRVPLPDENGNPPPGGLAVAVHAALRKNGGIWMGWSGRSTGEEEPQGLTTLEQDKISYVLTDLSQADLDEYYNGFANRVLWPIFHCRLDLAEYARQEMAGYFRVNRLFADRLVPMLEPDDVIWVHDYHLIPLAQELRKRGVRNRIGFFLHIPWPPADILTALPVYEIIMRGLAAYDLVGFQTDYDLDNFVGCLRREGWGDWSTPGWLRAFDKEVAAAAFPIGIETGDFARLAAKTDGLDLVTDMQQSLHGSSLIIGVDRLDYSKGIAARIDAFERYLMRNPDQAGKVTLLQVAPHSRSDVPEYLEMQGQVESHCGRVNGAHGTIEWVPIRYVNQSLTRPVLAGLYRLAKVGLVTPLRDGMNLVAKEYVASQDPADPGVLILSRFAGAARELDGAIFINPYDTEQTAGAIGRALSMPLDERIARWRRMMDHLESHDVLWWCRTFLAALNEAPEDNGALTRESD

SEQ ID NO: 65 - protein, 177 aa, Idiomarina loihiensis L2TR
MATVGIFFGSDTGNTEAVAQMIQKELGKKLVDVKDIAKSSKEDIANYDLLLFGIPTWYYGEAQCDWDDFFPELEEIDFTDKLIAIFGCGDQEDYAEYFLDAMGMVRDIVEARGGIIVGHWPTESYNFEASKGMADDTHFVGLGIDEDRQPELTKERVSKWCQQVYEEMCLAELASDS

SEQ ID NO: 66 - protein, 908 aa, Porphyra yezoensis
  misc_feature (612)..(612): Xaa can be any naturally occurring amino acid
MTPGPITTDAAAGVGVDTMDGTMKWELFEENRTLTTRSGQMIVNDGEFGKWNDTDEGRVKCFLTPDEGFGDAIESLVIVLYRLPIIAKRDATTGAWSFKWDDDALYLTSTGLRKGLEQLKVAPLWVGILNSDDEVPRQEREGVADRLLEEFNCVPVFIPHDTLKQLYQGFCKGTLWPLFHMVSSATDHTEHTTRFDDRLWRVYMNVNRMFRDKVVEVYDGDRTLIWVHDYHLMLLPQALRSRLSGVKIGFFLHIPWPSSEVYRVLPWRNELLKGMLSATLLGFHLFDYARHFLSACVRLLNLEHEANRGSLGLEYDGRHVMLRVSHIGVDPERFSEGLSAPSLTDRVAEFKERFADCTVLGAVDDLDLIKGIALKLMGFQRYLDSAPKMRGKVVLVQVAIPKAARVKESVRNEIRELVAAINNKHGDGSGRRPVWYLEESISFESRLALYSIMDALVVTPIRDGLNLIPYEYIVSTSEGKGQLILSEFTGCSRALSSAERVNPWDLEKLSNVLDMVVQKAIAAAPEVELKRRADKAYVSAHSSQQWAQSFLHDLKEASEPAQVVVKVGPLAGLPGVLAYDEFTLLNRSAVLRAYKAAKRRLFLFDYDGTLTXITDQSSQMAHAWARPSEAVAANLDTLSKDPLNDVYIMSGRKTEVLEAGLNNSPTIGIAAEHGFFYRKKNSKEWNRLLEDADLSWMELALRIMLMYTDRTDGSYVEQKKAGLVWHYLDADREFGSWQAKEMRDHLESLLSPFSVQVVTGYGWLQVRMAAMNKGVMVETILRDMPEPPDFVLCCGDDRTDEDMFAYLDTHLDPSVKQFTCTVGVKPSHARYYLHSSNEVGALLETLVTGSYPRGVRPRPRGGSVSLADLVPDDEGSSSTPAVPQRTNGPRTGASGQKRRGLASSLPSQ

SEQ ID NO: 67 - protein, 613 aa, Arabidopsis thaliana
MASVEGDDDFGSSSSRSYQDQLYTELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIVLDSETWNVFRFTGTIVGSGDLSSQWPASKWRSLQVQWDEPTTVQRPDKVSPWEIEPFLATSPISTPAQQPQSKCKRSRPIEPSVKTPAPPSFLYSLPQSQDSINASLKLFQDPSLERISGGYSSNNSFKPETPPPPTNCSYRLFGFDLTSNSPAPIPQDKQPMDTCGAAKCQEPITPTSMSEQKKQQTSRSRTKVQMQGIAVGRAVDLTLLKSYDELIDELEEMFEIQGQLLARDKWIVVFTDDEGDMMLAGDDPWNEFCKMAKKIFIYSSDEVKKMTTKLKISSSLENEEYGNESFENRSRG

SEQ ID NO: 68 - protein, 518 aa, Pycnoporus sanguineus
MGSGLFSLFVAIAAISGSLAAIGPKADLVISDAVVNPDGTPRAAVVVNGDFPGPLISGKKGDHFQLNVINKLTNHTMLKTTSIHWHGLFQEHTNWADGPAFVNQCPIASGHSFLYDFHVPDQAGTYWYHSHLSTQYCDGLRGPLVVYDPHDPQAHLYDVDNDDTVITLADWYHVAAKLGPQFPRGANSTLINGLGRAATDSTSDLTVITVEHGKRYRFRLVSISCDPNHTFSIDGHNMTIIEVDGVNSKPLTVDSIQIFAAQRYSFVLNANQPVDNYWIRANPSGGTLGFEGGINSVILRYKGAPDAEPTNTTAPTSVIPLVETNLHPLKPMQVPGRSGVGNVDYAKTLNFNFNGTNFFINNATFTPPTVPVLLQILSGAHNAQDLLPAGSVYTLPPHSAIEITMPATTMAPGSPHPFHLHGHVFAVVRSAGSSEYNYHDPIFRDVVSTGQPGDSVTIRFMTDNPGPWFLHCHIDFHLEAGFAIVFAEDVNDIKYANPVPPSWEELCPIYDKLPESDH

SEQ ID NO: 69 - protein, 485 aa, Thalassiosira pseudonana CCMP1335
KRLSIDTISDNLKAMEYAVRGKIAIEADRITEELKSSTDNKYPFDHIIMTNIGNPHAVQQKALTWPRQVMALLQLPDPLGIDHPSANALFPEDAIARAKEMKAALGGHGIGAYTHSKGVKEFREDVARFIEKRDGAEEGSVDVENIFLTAGASEAITMVMTALVKDSSCGIMLPIPQYPLYSATLDLLGGHKVGYYLDEQSIWGMKIEELERSLAEAKSQGINVVAFVLINPGNPSGAVLSRQEVKDIVMFCARHNLVLLSDEVYQENVYRKEDEFFSSRRAADELGLIKNDAIQLCSFHSVSKGVFGECGQRGGYVEMVGIEQDVNDCFYKLAASKLCSNAPGQAMVSLMCKGPNRGDSSYESHEKEKQAVFEGLRDRAQLVSEGLDSIPGFSCQPATGAMYCFPSVHMPPGAIKAAQDAGLPPDTLYSLDLLQTKGICVVPASGFGQKEGRYGFRTTFLSPEMKTVVESIRDHYEQFCSKYAE

SEQ ID NO: 70 - protein, 211 aa, Zea mays
  misc_feature (61)..(61): Xaa can be any naturally occurring amino acid
MARRRPMDYEELNEKVKKAQYAVRGELYLRASQLQKEGKKIIFTNVGNPHALGQKPLTFPXQVVALCQAPFLLDDPNVGLMFPPDAIVRAKRYLAMAPGGLGAYSDARGIPGIRKEVADFIHKRDGYPSDPELIYLTDGASKGVMQMLNAIIRNERDGILVPVPQYPLYSAIISLFGGSLVPYYLEEEANWNLDFANIRQAVAEARSKGIT

SEQ ID NO: 71 - protein, 386 aa, Ganoderma lucidum
WHGLFQEGTNWADGPAFINQCPIASGHSFLYDFQVPDQAGTYWYHSHLSTQYCDGLRGPFVVYDPKDPLKRLYDVDDDSTVITLADWYHVAAKLGPRFPLGSDSTLINGLGRSTTNVTADLAVITSPRGNPLSLPPCVLSCDPNYTFSIDGHNMTVIEADGIETHPVTVNAIQIFSAQRYSFVLTANQTIDNYWIRANPNFGNVGFTDGINSAILRYSGADPVEPTTTQQTTQNLLNEVDLHPFPGRATQGGVDVAINMDFNFNGSNFFINNASFTPPTVPVLLQILSGAQSAQDLLPSGSVYTLPINKSIELTFPATANAPGAPHPFHLHGHAFAVIRSAGSTEYNYNNPVWRDVVSTGTPAAGDNVTIRFQTDNPGPWFLHCHI

SEQ ID NO: 72 - protein, 520 aa, Ganoderma lucidum
MARFQSLLSYITLLFAASAYAGIGPKTDLTISNADVAPDGFTRAAVVVNGVVPGPLITGNQGDRFQLNVIDQMTNHTMLKTTSIHWHGFFQKGTNWADGPAFVNQCPIASGNSFLYDFQVPDQSGTHWYHSHLSTQYCDGLRGPFVVYDPNDPLKNLYDVDDDSTVITLADWYHTAARLGPRFPLGSDSTLINGLGRSPATPTADLAVISVTQGKRYRFRLVSLSCDPNYVFSIDGHDLSVIEADGIETQPVTANAIQIFSAQRYSFVLTANQTVDNYWVRANPNFGNVGFTDGINSAILRYDGADPVEPVTSQQTTQNLLLETDLHPFVSRATPGNPTQGGVDKAINFLFNFNGTNFSINNASFVPPTVPVLLQILSGAQTAQNLLPSGSVYELPINSSIELTFPATANAPGAPHPFHLHGHAFAVVRSAGSTVYNYDNPVWRDVVSTGTPAAGDNVTIRFQTDNPGPWFLHCHIDFHLDAGFAVVMAEDSPDASAANPVPQAWSDLCPTYNALSPNDQ

SEQ ID NO: 73 - protein, 165 aa, Mycoplasma penetrans HF-2
MKIAIIYGSTLGNTERAANSIAQEFNLPNIDILNVAETKAEQLNQYDKIIFGSSTWGLGDLQDDWDEFDFENLKVENKTVAIFGMGDSEVYAFTYCDSISKIHKILKSKNANIVGYVSDKDYKYTKSESVENGMFLGLALDDDNYEDLTESRIKKWVNDIRKHFE

SEQ ID NO: 74 - protein, 520 aa, Ganoderma lucidum
MARFQSLLSYITLLFAASAYAGIGPKTDLTISNADVAPDGFTRAAVVVNGVVPGPLITGNQGDRFQLNVIDQMTNHTMLKTTSIHWHGFFQKGTNWADGPAFVNQCPIASGNSFLYDFQVPDQSGTYWYHSHLSTQYCDGLRGPFVVYDPNDPLKNLYDVDDDSTVITLADWYHTAARLGPRFPLGSDSTLINGLGRSPATPTADLAVISVTQGKRYRFRLVSLSCDPNYVFSIDGHDLSVIEADGIETQPVTANAIQIFSAQRYSFVLTANQTVDNYWVRANPNFGNVGFTDGINSAILRYDGADPVEPVTSQQTTQNLLLETDLHPFVSRATPGNPTQGGVDKAINFLFNFNGTNFSINNASFVPPTVPVLLQILSGAQTAQNLLPSGSVYELPINSSIELTFPATANAPGAPHPFHLHGHAFAVVRSAGSTVYNYDNPVWRDVVSTGTPAAGDNVTIRFQTDNPGPWFLHCHIDFHLDAGFAVVMAEDSPDASAANPVPQAWSDLCPTYNALSPNDQ

SEQ ID NO: 75 - protein, 521 aa, Ganoderma tsugae
MARLQSFLPYFPLLFAASAYAAIGPVANLTISDADIAPDGFTRAAVVVNGVSPGPLITGNKGDNFQINVINQMTNHTMNKTTSIHWHGLFQEGTNWADGPAFVTQCPIVSGNSFLYNFHVPDQAGTFWYHSHLSTQYCDGLRGPLVVYDPHDPLAHMYDVDDDSTVIALTEWYWTASHLGTRFPAGLANSTLINGLGRTTATSSAELAVVNVTQGKRYRFRLVSMACDPSFNFSIDGHDLTVIEADGVETQPVTVNSINIFAAQRYSFVLTANQTIDNYWIRANPSLGVMGFDAGINSAILRYDGAAPVEPVTSPQSTQILLNETDLHPYVPRKTPGKPEKGGVDLPLNMAFGFDGTDFFINNATFVPPTVPVLLQILSGAQAAQDLLPAGSVYTLPKNASIEITFPANANAAGSPHPFHLHGHTFAVIRSAGSTAYNYDNPVWRDTVSTGLATNNDNATIRFQTDNAGPWFLHCHIDFHLNAGFAVVLAEDVPDIARANPVPQAWKNLCPTYDALSPNDQ

SEQ ID NO: 76 - protein, 404 aa, Streptococcus thermophilus LMG 18311
MKTFDKSSKLEHVAYDIRGPVLDEANRMIAKGEKILRLNTGNPAEFGFTAPDEVIRDLIMNVRNSEGYSDSKGIFSARKAIMQYCQLKGFPNVDIDDIYIGNGVSEMIPMSMQALLDDGDEVLVPMPDYPLWTACVSLAGGNAVHYVCDEKSNWYPDIDDIKSKITSNTKAIVIINPNNPTGALYPKDVLEQIVDIARQNDLIIFADEIYDRLVMDGKKHIAIASLAPDVFCVSMNGLSKSHRICGFRVGWMVLSGPKKNVRGYIEGLDMLSNMRLCSNVLSQHVIQTSLGGYQSVDELLIPGGRIYEQREFITNTVNDIPGLTAVKPDAGLYIFPKIDRNMYDIDDDEEFCLRLLKKEKVLLVPGKGFNWNEPDHFRIVYLPRVEELADLGNKIERVLLYYKR

SEQ ID NO: 77 - protein, 434 aa, Geobacter sulfurreducens PCA
MRNELVTPGAGELTYEIRNIVNVAEKLQKHGVKINWENIGDPIVKKEEIPRWMKEIVAAAVMENDTWGYCHTRGVLETREFLCGLTNNRGGAQITPDDIIFFNGLGDAISTVYGNLRHESRILMPSPTYTTHSIGEAAHAQAAPVCYRLKPEDNWFPDVEDLENHVKYNPQISGILLINPDNPTGMVYPREILEQIVAIARRYDLFIIADEVYNNITYNGQTTVPISDVIGEVPAIAMKGISKEIPWPGSRCGWIEVYNGNRDEQFHKFLNSILTAKMNEVCSTTLPQKCIPAIMKHPEYQTYLRERIACYERMSTITYDCLKQVPGLMVNRTNGAFYMSVAFRDGLLTDRQSLPIESVEVRELVEKLVNAPGVSPDKRFVYYILASTGICIVPLSSFNTPLQGFRVTLLEKDENECMRIYRTLAERIKEYLNS

SEQ ID NO: 78 - protein, 169 aa, Anabaena sp.
AKKIGLFYGTQTGKTESVAEIIRDEFGNDVVTLHDVSQAEVTDLNDYQYLIIGCPTWNIGELQSDWEGLYSELDDVDFNGKLVAYFGTGDQIGFADNFQDAIGILEEKISQRGGKTVGYWSTDGYDFNDSKALRNGKFVGLALDEDNQSDLTDDRIKSWVAQLKSEFGL

SEQ ID NO: 79 - protein, 151 aa, Synechococcus sp. CC9605
MKVLLPGSELKDLDRIDFTKELEESEALICCTPTWNTGSETKRSGTTWDQHIDNIPHLSLKGKPIAIVGLGDSAAFSKYFCDAMEELYKLFESAGGRMIGHVSVEQYIFDNSKSVVDGMFCGLPLDEDNESEKTDERLQSWARLIMQEAII

SEQ ID NO: 80 - protein, 521 aa, Ganoderma tsugae
MARLQSFLPYFPLLFAASAYAAIGPVANLTISDADIAPDGFTRAAVVVNGVSPGPLITGNKGDNFQINVINQMTNHTMNKTTSIHWHGLFQEGTNWADGPAFVTQCPIVSGNSFLYNFHVPDQAGTFWYHSHLSTQYCDGLRGPLVVYDPHDPLAHMYDVDDDSTVITLTEWYWTASHLGTRFPAGLANSTLINGLGRTTATSSAELAVVNVTQGKRYRFRLVSMACDPSFNFSIDGHDLTVIEADGVETQPVTVNSINIFAAQRYSFVLTANQTIDNYWIRANPSLGVMGFDAGINSAILRYDGAAPVEPVTSPQSTQILLNETDLHPYVPRKTPGKPEKGGVDLPLNMAFGFDGTDFFINNATFVPPTVPVLLQILSGTQAAQDLLPAGSVYTLPKNASIEITFPANANAAGSPHPFHLHGHTFAVIRSAGSTAYNYDNPVWRDTVSTGLASNNDNVTIRFQTDNAGPWFLHCHIDFHLNAGFAVVLAEDVPDIARANPVPQAWKNLCPTYDALSPNDQ

SEQ ID NO: 81 - protein, 519 aa, Trametes versicolor
MGLQRFSFFVTLALVARSLAAIGPVASFVVANAPVSPDGFLRDAIVVNGVVPSPLIRAKKGDRFQLNVVDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATVINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTPSVIPLIETNLHPLARMPVPGTRTPGGVDKALKLAFNFNGTNFFINNASFTPPTVPVLLQILSGAQTAQELLPAGSVYPLPAHSTIEITLPATALAPGAPHPFHLHGHAFAVVRSAGSTTYNYNDPIFRDVVSTGTPAAGDNVTIRFQTDNLGPWFLHCHIDFHLEAGFAIVFAEDVADVKAANPVPKAWSDLCPIYDGLSEADQ

SEQ ID NO: 82 - protein, 175 aa, Vibrio salmonicida LFI1238
MASVGLFFGSDTGNTEAIGKMIQKQLGKKLVHVQDIAKSSKEDIDNFDLLLLGIPTWYYGEAQCDWDDFFPELEGIDFSTKLVAIFGCGDQEDYAEYFCDAMGNIRDIVEAKGGTVIGYWPTEGYEFEASKALVDENNFVGLCIDEDRQPELTEERVTAWVKQIHEEMCLAELED

SEQ ID NO: 83 - protein, 163 aa, Helicobacter pylori
GKIGIFFGTDSGNAEAIAEKISKAIGNAEVVDVAKASKEQFNGFTKVILVAPTAGAGDLQTDWEDFLGTLEASDFANKTIGLVGLGDQDTYSETFAEGIFHIYEKAKAGKVVGQTSTDGYHFAASKAVEGGKFVGLVIDEDNQDDLTDERIAKWVEQVRGSFA

SEQ ID NO: 84 - protein, 178 aa, Methylococcus capsulatus str. Bath
MGKIGIFFGSDTGNTRRVAKQLAKKLGEDADAPVDVKKADIDDVLKYDALILGTPTLGDGELPGLDSGASEESWLEFLPKFKGKDMSGKTVALFGLGDQQGYGHEFVDALREIYDQVVECGARVVGAWPTDTYEFEKSKAVVDGKFVGLVIDHENQSEMTDERLDEWLEIVRPALVGA

SEQ ID NO: 85 - protein, 503 aa, Coprinopsis cinerea
AIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVIYDDNDPHAALYDEDDENTIITLADWYHIPAPSIQGAAQPDATLINGKGRYVGGPAAELSIVNVEQGKKYRMRLISLSCDPNWQFSIDGHELTIIEVDGELTEPHTVDRLQIFTGQRYSFVLDANQPVDNYWIRAQPNKGRNGLAGTFANGVNSAILRYAGAANADPTTSANPNPAQLNEADLHALIDPAAPGIPTPGAADVNLRFQLGFSGGRFTINGTAYESPSVPTLLQIMSGAQSANDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTV

SEQ ID NO: 86 - protein, 484 aa, Zea mays
  misc_feature (377)..(377): Xaa can be any naturally occurring amino acid
  misc_feature (439)..(439): Xaa can be any naturally occurring amino acid
  misc_feature (460)..(460): Xaa can be any naturally occurring amino acid
  misc_feature (463)..(463): Xaa can be any naturally occurring amino acid
  misc_feature (470)..(470): Xaa can be any naturally occurring amino acid
MAATVAVDNLNPKVLKCEYAVRGEIVIHAQRLQQQLQTQPGSLPFDEILYCNIGNPQSLGQQPVTFFREVLALCDHPDLLKKEEIKTLFSADSISRAKQILALIPGRATGAYSHSQGIKGLRDAIASGIASRDGFPANADDIFLTDGASPGVHLMMQLLIRNEKDGILVPIPQYPLYSASIALHGGSLVPYYLNESTGWGLEISDVKKQLEDARSRGIDVRALVVINPGNPTGQVLAEENQYDIVKFCKNEGLVLLADEVYQENIYVDNKKFHSFKKIVRSLGYGEEDLPLVSYQSVSKGYYGECGKRGGYMEITGFSAPVREQIYKIASVNLCSNITGQILASLVMNPPKASDESYASYKAEKDGILASLARRAKXALEAAFSKLEGITCNKAEGAMYLFPQICLPQKAIEAAKAANKAPDAFYALRLLESTGIVVVXPGSGFGQVPGTWHFRCTILPXEEXIPAIISXFTVFHEAFMAEYRD

SEQ ID NO: 87 - protein, 636 aa, Saccharomyces cerevisiae YJM789
MTNALLSIAVLLFSMLSLAQAETHTFNWTTGWDYRNVDGLKSRPVITCNGQFPWPDITVNKGDRVQIYLTNGMNNTNTSMHFHGLFQNGTASMDGVPFLTQCPIAPGSTMLYNFTVDYNVGTYWYHSHTDGQYEDGMKGLFIIKDDSFPYEYDEELSLSLSEWYHDLVTDLTKSFMSVYNPTGAEPIPQNLIVNNTMNLTWEVQPDTTYLLRIVNVGGFVSQYFWIEDHEMTVVEIDGITTEKNVTDMLYITVAQRYTVLVHTKNDTDKNFAIMQKFDDTMLDVIPSDLQLNATSYMVYNKTAALPTQNYVDSIDNFLDDFYLQPYEKEAIYGEPDHVITVDVVMDNLKNGVNYAFFNNITYTAPKVPTLMTVLSSGDQANNSEIYGSNTHTFILEKDEIVEIVLNNQDAGTHPFHLHGHAFQTIQRDRTYDDALGEVPHSFDPDNHPAFPEYPMRRDTLYVRPQSNFVIRFKSDNPGVWFFHCHIEWHLLQGLGLVLVEDPFGIQDAHSQQLSENHLEVCQSCSVATEGNAAANTLDLTDLTGENVQHAFIPTGFTKKGIIAMTFSCFAGILGIITIAIYGMMDMEDATEKVIRDLHVDPEVLLNEVDENEEREVNEDRHSTEKHQFLTKAKRFF

SEQ ID NO: 88 - protein, 474 aa, Pseudomonas savastanoi
MSRLVVVSNRIAPPDEHAASAGGLAVGILGALKAAGGLWFGWSGETGNEDQPLKKVKKGNITWASFNLSEQDLDEYYNQFSNAVLWPAFHYRLDLVQFQRPAWDGYLRVNALLADKLLPLLQDDDIIWIHDYHLLPFAHELRKRGVNNRIGFLLHIPFPTPEIFNALPTYDTLLEQLCDYDLLGFQTENDRLAFLDCLSNLTRVTTRSAKSHTAWGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLMKIFRYSDVGLVTPLRDGMNLVAKEYVAAQDPANPGVLVLSQFAGAANELTSALIVNPYDRDEVAAALDRALTMSLAERISRHAEMLDVIVKNDINHWQECFISDLKQIVPRSAESQQRDKVATFPKLA

SEQ ID NO: 89 - protein, 179 aa, Azotobacter vinelandii
AKIGLFFGSNTGKTRKVAKSIKKRFDDETMSDALNVNRVSAEDFAQYQFLILGTPTLGEGELPGLSSDCENESWEEFLPKIEGLDFSGKTVALFGLGDQVGYPENYLDALGELYSFFKDRGAKIVGSWSTDGYEFESSEAVVDGKFVGLALDLDNESGKTDERVAAWLAQIAPEFGLSL

SEQ ID NO: 90 - protein, 499 aa, Trametes versicolor
AIGPAASLVVANAPVSPDGFLRDAIVVNGVFPSPLITGKKGDRFQLNVVDTLTNHTMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWIRANPNFGTVGFAGGINSAILRYQGAPVAEPTTTQTTSVIPLIETNLHPLARMPVPGSPTPGGVDKALNLAFNFNGTNFFINNASFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLEAGFAIVFAEDVADVKAANPVPKAWSDLCPIYDGLSEANQ

SEQ ID NO: 91 - protein, 888 aa, Candida albicans SC5314
MAPQQVNAFSANGSIPSPKEFEGKGKLKLSGRILNVMTSLPLQIISDYDNKTGQYYWDVETVRGNSALYSSQHFLAENKEWETHLIAWTGELINKKKDTSSLTADTLQDDPLYLDEEDKSKIEKKLCDASGTPNIHPVWLLRRDQGRWRKYAENVLWPVFHYIQGQPSDGKAETDAWHDYVKFNEAYLNKIKSVYKPGDIIWIHDYYLLLLPQLLRMEFPNAYIGFFLHVPFPSSEYFRCLSKRSQLLDGMLGADKIGFQSDSFQRHFISCCARVLGCEVNRDSVSAYGTTISVETLPIGIDTEKIEHDAFSSELGVEEKVQALKQVYKGKKLIVGRDRLDKVRGVIQKLEGFEIFLDMYPEWRETVVLIQVSSPGYSHSANVETRVTEIISRINSKYGNLNHTPVLHYQMRVAKEEYLALLRVADLALITSVRDGMNTTSLEFVICQKYNNSPLILSEFTGTATVLKDAIMVNPWDSVGVAKTINDALMLSTKEKVSLESKLYEKVLSNTVQNWTSTFICDILSHSIVTHSNSYTPALNRPLLLNNYKESQRRLFLFDYDGTLTPIVQDPAAAIPSDKLNRILDVLSSDPKNQIWIISGRDQAFLEKWMGNKNVGLSAEHGCFMKDIGSKEWVNLAASFDMSWQEKVDDIFKYYTEKTPGSNIERKKVALTWHYRRADPDLGNFQAEKCMKELNDTVAKEYDVEVMAGKANIEVRPKFVNKGEIVKRLVLHPHGAKQEKHPTGHCTKDIPIEELPDFMLCLGDDLTDEDMFNSLNEINKKWKGDNRPTNKFGSYGVYPVAVGPASKKTVAIAHLNEPRQVLETLGLLAGLVSIFESAGTVDLDDRGHLANSVSSERSKHAVSKAVSLRKKASQEKEIVKEDPTNGAK

SEQ ID NO: 92 - protein, 463 aa, Ralstonia eutropha JMP134
MPRLVAVSNRVADPRNVAAGGLAVALSEALRQTGGMWFGWSGKALETNHGGTPGEGELHLQQAGNVTLATVDMCREDHDAYYLGYSNGVLWPAFHYRLDLADFDSNYLNGYRRVNQLFARKLAPLLKPDDIIWIHDYHLIPLAAELRAIGCGQRIGFFLHIPLPPPLILAAIPQHDWLMRALFAYDLIGFQSHTDLEHFSRYVQNEAFAEPMGEHRYRAFHRTVRAEAFPIGIDVEEFRELGRGAEAQETFEMMRAQYASRRLLLGIDRLDYSKGLPQRLKAFYRLLAEYPENRMSATLVQIAAPSRESVDAYADLRSEMERLSGAINGEFGELDWMPVRYIHRTTARKRLPGLCRASRVALVTPLRDGMNLVAKEFIAAQDREDPGVLVLSRFAGAAEQLKEALLVNPYDTHATAQAIQQALHMPLAERQARHEKLLERIRTQDVHWWSQEFLRALTETDGG

SEQ ID NO: 93 - protein, 503 aa, Mycobacterium smegmatis str. MC2 155
MSPESGHETISGTSDFVVVANRLPVDLERLPDGTTRWKRSPGGLVTALEPLLRKRRGSWIGWAGVADSDEEPIVQDGLQLHPVRLSADDVAKYYEGFSNATLWPLYHDLIVKPEYHREWWDRYVEVNRRFAEATARAAAEGATVWIQDYQLQLVPKMLRMLRPDVTIGFFLHIPFPPVELFMQMPWRTEIVEGLLGADLVGFHLPGGAQNFLVLSRRLVGANTSRASIGVRSRFGEVQVGFRTVKVGAFPISIDSAELDGKARNRAIRQRARQIRAELGNPRKIMLGVDRLDYTKGIDVRLRALSELLEEKRIKRDDTVLVQLATPSRERVESYIAMREDIERQVGHINGEYGEVGHPIVHYLHRPIPRDELIAFFVAADVMLVTPLRDGMNLVAKEYVACRSDLGGALVLSEFTGAAAELRQAYLVNPHDLEGVKDKIEAAVNQNPEEGKRRMRALRRQVLAHDVDRWARSFLDALAATGETGDSGVTGESTPAPESDSGSF

SEQ ID NO: 94 - protein, 534 aa, Clavibacter michiganensis subsp. sepedonicus
MTPPPSSTPSATEPTTEPRTADAHDGDVEPGAYDLVVVSNRLPVDRVVAADGTTSWRHSPGGLVTALEPVMRANEGAWVGWPGIADHDVEPFVDAGISIIPVTLTEQDLAEYYEGFSNDTLWPLYHDVIAQPSYHREWWDTYVTVNQRFADAAAKAAAPGATVWVQDYQLQLVPKMLREQRPDLTIGFFNHIPFPPYGIYSQLPWRTQIIEGLLGADVIGFQRVADAGNFTRAVRRLFGYTTRGSTVDVPVRGGIPLTVPGTKPSKPVRELRTRQVVAKHYPISIDARSYEEMAKDPAIQERARQIRADLGDPKTILLGVDRLDYTKGIGHRLKAFGELLAEGRVTVEDATLVQVASPSRERVETYKQLRDEIELTVGRINGDYGSISHTAISYLHHGYPREEMVALCLAADVMLVTALRDGMNLVAKEYVATKHSNEGVLVLSEFAGAADELKAALLVNPHDIEGLKEAILRAIEMPKAEQRKRMRSLRKRVFENDVTAWSSSFLADLGRTHAASIHEGPDEEVVEPLMDEGW

SEQ ID NO: 95 - protein, 489 aa, Mycobacterium sp. MCS
MASEGDPGVGSGDSDFVVVANRLPIDMERLPDGSTSFKRSPGGLVTALEPLLRKRHGAWIGWAGIPDSAEDPIEDDGLQLYPVSLSADDVADYYEGFSNATLWPLYHDLIVKPIYHRKWWDRYVEVNRRFAEATARAAAEGATVWVQDYQLQLVPKMLRMLRPDLTIGFFLHIPFPPVELFMQMPWRTEIIEGLLGADLVGFHLPGGAQNFLYLARRLTGANTSRATVGVRSRFGEVQVGFRTVKVGAFPISIDSDELDGKARNRAVRQRAREIRNELGNPRKILLGVDRLDYTKGINVRLEALSELLEDGRVDSHDTVFVQLATPSRERVQSYIEMREDIERQVGHINGEFGDVGHPIVHYLHRPIPRDELIAFFVAADVMLVTPLRDGMNLVAKEYVACRSDLGGALVLSEFTGAAAELRQAYLANPHHLEGVKDAIEAALNQDPEEGRRRMRALRRQVLAHDVDRWARAFLDALADTRAGAKPVRD

SEQ ID NO: 96 - protein, 290 aa, Brassica napus
HASADAWAVSIKILPVGIHMGQIEEIKVAEETAEKVKGLRERFKEKIVMLGVDDLDMFKGISLKFWAMGQLLEQNKELRGKVVLVQITNPARSSGKDVQDVETQIHLIADEVNNKFGRPGSGYKPIVFVNGPVSTLDKVAYYAISECVVVNAVRDGMNLVPYKYTVTRQGSPVLDEALGLGAGDVRKSVIIVSEFIGCSPSLSGAIRVNPWNIDAVTDAMSSAVTMSDKEKNLRHQKHHKYISSHDVAYWSRSYDQDLQRACKDHYNKRFWGVGLGLVFRVVALDPNFRK

SEQ ID NO: 97 - protein, 472 aa, Acidovorax sp. JS42
MSRLVVISNRLADPRKSAAGGLAVALGDALARTGGLWFGWSGTVTADGTPGEGALQTHQAGNVTLATVDLCQADHAAYYQGYANSVLWPVLHYRLDLADFSANYSEGYRRVNQMFARKLLPLLREDDVIWVHDYHLIPLAAELRALGCRQRIGFFLHVPVPPPLILAALPQHEWLMRSFFAYDLVGLQSEADVVHFTRYMVNEAHAQELDGQRLRAFNATVRVAAFPIGIDVQEFQRLGRAPDAVHTCEALRAEYSRRQLLLGIDRLDYSKGIPHRVRAFRQLLERYPENEHSATLVMIASPSRDDVHAYADLRQELEGLCGAINGDYGDLDWMPLRYIHRTVARKRVPGLCRAARVGLVTPLRDGMNLVAKEYVVAQEPEDPGVLVLSRFAGAAEQLKEALLVNPYDTQGMADAIQTALRMPLSERQWRHERLMERIQRQDVHWWRNSFLQALRDEAAPPVTAPAGAVAAT

SEQ ID NO: 98 - protein, 126 aa, Zea mays
FPQILFPPRAFGAARRAGKSGEFFFSLKFRGGPGISPFPGFGFGQKEGVFPLRPPSLPAGEDFPPPMSSFKKFNDSFMDQYGGSSRLWAGREPRDSSFEEEIFVWKLFIFCNPLENQVGGGFFFFE

SEQ ID NO: 99 - protein, 167 aa, Brassica juncea
RLVPRNEKTAYYAMADCCLVNAVRDGMNLVPYKYIICRQGTPGIDKAMGTSRDSPRTSMLVVSEFIGCSPSLSGAIRVNPWDVDAVAEAVNLALKMSEAEKRLRHEKHYHYVSTHDVGYWAKSFLQDLERASQDHYNKRCWGIGFGLSFRVLSLSPSFRKLSIDHIV

SEQ ID NO: 100 - protein, 175 aa, Candidatus Blochmannia floridanus
MKKASVGIFFGSDTGNTEKLANIIQLRIGKDLSDIFDISNSCKEDIENYDRLIFGIPTWYYGEPQCDWDSFLPIFRKINFLGKKIAIFGCGDQEDYSEYFCDAMSILYNIVINKGAIVVGLWPTSGYYFDMSKSIIDGNKFIGLAIDEDRQPDMTETRVKTWVKQIFLEMNLNLI

SEQ ID NO: 101 - protein, 484 aa, Oryza sativa Indica Group
MFGGGGGGRKPLDYEELNENVKKVQYAVRGELYLRASELQKEGKKIIFTNVGNPHALGQKPLTFPRQVVALCQAPFLLDDPNVGLIFPADAIARAKHYLAMAPGGLGAYSDSRGIPGIRKEVAEFIERRDGYPSDPELIYLTDGASKGVMQMLNTIIRNERDGILVPVPQYPLYSAAISPFGGSLVPYYLEEEANWGLDFVNLRQTVASARSKGITVRAMVIINPGNPTGQCLSEGNIKELLKFCFHENLVLLADEVYQQNIYQDERPFISARKVLFDMGPPMSREVQLVSFHTVSKGYWGECGQRGGYFEMTNLPPKTVDEIYKVASIALSPNVPGQIFMGLMVNPPKPGDISYLKFSAESKSILESLRRRARLMTDGFNSCRNVVCNFTEGAMYSFPQIRLPPKAIDAAKRAGKAADVFYCLKLLEATGISTVPGSGFGQKEGVFHLRTTILPAEEDMPAIMTSFKKFNDTFMDQYDGYSRM

SEQ ID NO: 102 - protein, 540 aa, Arabidopsis thaliana
MRRFLINQAKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILSPIPQYPLYSASIALHGGSLVPYYLDEATGWGLEISDLKKQLEEARSKGISVRALVVINPGNPTGQVLAEENQRDIVNFCKQEGLVLLADEVYQENVYVPDKKFHSFKKVARSLGYGEKDISLVSFQSVSKGYYGECGKRGGYMEVTGFTSDVREQIYKMASVNLCSNISGQILASLVMSPPKPGDDSYDSYMAERDGILSSMAKRAKTLEDALNSLEGVTCNRAEGAMYLFPRINLPQKAIEAAEAEKTAPDAFYCKRLLNATGVVVVPGSGFGQVPGTWHFRCTILPQEDKIPAIVNRLTEFHKSFMDEFRN

SEQ ID NO: 103 - protein, 492 aa, Xanthobacter autotrophicus Py2
MSRIVVVSNRVAVPQRSGVTAGGLAVAVNAALKDKGGIWFGWSGRICPEPSEIPEVTRKAGITYAVVDLKAEDHQEYYNGFANRVLWPVLHYRVDLSEFFRSDLSGYIRVNRMFADHLEKIIRPDDILWIHDYHMMPLAKYLRERGHKNRIGFFLHIPMPPSDIVQALPQHGETVGALAYYDLVGFQTEGDRDNFAHYLEIRGGQLTPDGTGVDIGGRRVRLGTFPVGIETAAFARRARHASRAAFVKSFRDSLVGKKLIIGVDRLDYSKGIPNRLEAYEQFLKTQPDWHERVTFVQITPKSRTDVPEYQEMDRYVSHKAGQINGAYSDVSWTPLRYVNRTYSRSALAGFYRAAHVAMVTPLRDGMNLVAKEFVAAQDPADPGVLILSQFAGAAAEMGTGALIVNPHDTEGMANALRRALEMPLAERRERYARMMQVLEARDIDRWAADYLAALAPEAATVERRGLSLPRAAIRSVVRLPGAWRSDFVPRGA

SEQ ID NO: 104 - protein, 736 aa, Robiginitalea biformata HTCC2501
MSKTIIISNRLPVQLQIKEGSIEATPSVGGLATGMKSVHSDGESLWIGWSGLTLEEIPDSLDADIDQALARHGCSRVDLSKNEVDGFYYGFSNRTIWPLFHYFMEYSEFELSNWTVYEAVNRKFADAIAAAAADDDVIWVHDYQLMLVPQMVREQRPGLSIGFFLHIPFPSYEIFRTMPWRREVLRGLLGSDLIGFHTYDYERHFLSSVRRLLGLEVSFNEIHLEDRVVKVDSFPMGIDYKKFNEAAARHRDMKPGEISDLQNRLDTHKASTPDAKFFLSIDRLDYTKGIARRIKAFEYFLEKYPEYKEKVRLIILAVPSRSKVPQYQRLKREIDELVGRINGELSTVSWTPIWYFYRSLPFDNLIDLYTSCDIAWLTPIRDGMNLVAKEYIATRTDQTGVLILSEMAGSANEMNEALLINPNNFEQIAESLHQALNMPEEEQKRRNAAMQKRLERYNVEKWANDFMNSLLTQRQQDYSMVARRLSVDLTNTLLEKYREARSRILFLDYDGTLAGFTNDPQDARPDEALMELLDRLNAQGRTDVFLISGRDKDTFTRWFQDKEYAMIVEHGVWISEGGKPFSMLENVKNDWMGKIRPVLESFVDRTPGSFIEDKNYSLAWHYRNTDPDFGQKRTMELNTVLTSLIANDDLTVMNGNKVVEIKSSNVNKGRAAMRMVARKEYDFIFAIGDDWTDEFMFQELPKEAVTVKVGRMKTQARYFLDGPGAVRQLLGRFADI

SEQ ID NO: 105 - protein, 602 aa, Arabidopsis thaliana
MASVEGDDDFGSSSSRSYQDQLYTELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIFTGTIVGSGDLSSQWPASKWRSLQVQWDEPTTVQRPDKVSPWEIEPFLATSPISTPAQQPQSKCKRSRPIEPSVKTPAPPSFLYSLPQSQDSINASLKLFQDPSLERISGGYSSNNSFKPETPPPPTNCSYRLFGFDLTSNSPAPIPQDKQPMDTCGAAKCQEPITPTSMSEQKKQQTSRSRTKVQMQGIAVGRAVDLTLLKSYDELIDELEEMFEIQGQLLARDKWIVVFTDDEGDMMLAGDDPWNEFCKMAKKIFIYSSDEVKKMTTKLKISSSLENEEYGNESFENRSRG

SEQ ID NO: 106 - protein, 1116 aa, Debaryomyces hansenii
MTIIIGTLFLPYTVKFDVGGRVDYDIDITQKDATVPNIQNDARNQQRKSVSAGMGTGISQSSILPSLSTSQQHTPRSGSPTFNDNASIMTGSDTDQVNSAQEFFHSHKRTPHDSQNILTDNLYDKLGSKLIQPRSRYSNVAFQSSVVDPKKKSEDAGLPGLKINRSSNNLTSLNNSSFSSYSNMIGLNPTTNSSTMSVPSTRQRTPISRQGFTLHSNSSSNSIPTRIKEVEEEEARESDYASDKSVDEDHIENFNDLVHGRTESKLTPFGGFSKPDLEDGILNQENIFEDAPWKVVLAGKGNVSLTKAVQIAVDAGGINDHKWVGTLAMPSDAVPNSVINGISDSLSENYDCEAVFPNDITFQGHYKSFCKQILWPTLHYQIPDDPKSKAFEDHSWGHYKLLNQLVADKIVDLYKKENGSSDPNDPNNMIWIHDYHLLLVPKMIREKLPEAKIGLFLHVSFPSSEVFRCFAQRKAILSGMLGANCITFQTDEYVRHFWQTCNRLLLADANEFGITYEGKFTMINTIPVGVDAKSLEGYLGSNEVNEWRNMIRERWSNKKLIVSRDKLEKLRGIKQKLLAYEKFLHSNPEYVDTTVLIQICPGTTQDSSYESEIMSIVGRINALTGDISFSQPVVLLQQDIGFEQYVALQCEAEVFVVASMREGLNLTCHEYIIATTEKKSPLMLSEFTGSSPLLNCNGEGAILINPWDLKRFAELFKVSLDMGQDEKVKRWTNCYKTICNHDSRNWVENCLQGINEGWDYDHSRNLNKLIPFTRDIFDSFYSRNDGGKRLFFLNLDTPSAIASTNDPSSKFHKLTSKSAVAAAGKNGAFSESSRFASLLNELLSDPLNHVYLTSYLKRSDLDTLYNRSPNLGLVAENGGYIKLTESDKWISIIDEVELEGWMPQVSQLIASKVERLPGSHMEVEDCTIRFHPGKSFENDRERSLSILGDCIQHVNELFSDQDGVHATLIRNVLIVQKNKLSMKALKFIISYYNQKKQGIKSESLIEEYQVKQVPGSAPSTPISETASLPPIKSPTSKIQKNLVTALFLSGGSTLIDEPGYEYANGLERSGEIPEVITVTVLGADSRTSATYCVSGKNELLGILSNPVSEPYKSHTA

SEQ ID NO: 107 - protein, 175 aa, Vibrio cholerae O1 biovar eltor str. N16961
MASVGIFFGSDTGNTEAIAKMIQKQLGKKLVHVQDIAKSSKEDINNFDLLLLGIPTWYYGEAQCDWDDFFPELEAIDFSTKLVAIFGCGDQEDYAEYFCDAMGTVRDIIQAKGATIVGHWPTEGYEFEASKALVDENHFVGLCIDEDRQPELTEQRVTKWVNQVYEEMCLAELED

SEQ ID NO: 108 - protein, 514 aa, Bifidobacterium longum NCC2705
MFAERLRNAMNSRGLKQVDLVHAAEHRGVKMGKSHISQYVAGKTMPREDVLEFLASELDVDMNWLRGEESTTQLNSDASNSVTDGEHAATPLATGASKPQTDSEIPVGRRRTFGKSHKLDNVLYDVRGPVADEAMRMEANGTHILKLNIGNPAPFGFRTPDEVVYDMAHQLTDTEGYSPSKGLFSARKAIMQYAQLKNIPNVTIDDIYTGNGVSELINLSMSALLDTGDEVLVPSPDYPLWTACVNLAGGTAVHYLCDEQSEWYPDIDDIRSKITSNTKAIVIINPNNPTGALYPKEVLQQIVDIAREHQLIIFSDEIYDRLVMDGLQHISIASMAPDLFCVTFSGLSKSHMIAGYRIGWMILSGNKRIAKDYIEGLNMLANMRMCSNVPAQSVVQTALGGHQSVNDYIVPGGRVHDQRDLVYDMLNQIPGITAVKPKAAFYIFPKIDVKRFNIHSDEQFALDLLHDKHILISHGGAFNWHRPDHFRVVYLPRMGMLRETMGEISDFFSYYWQS

SEQ ID NO: 109 - protein, 164 aa, Helicobacter pylori J99
MGKIGIFFGTDSGNAEAIAEKISKAIGNAEVIDVAKASKEQFNGFTKVILVAPTAGAGDLQTDWEDFLGTLEASDFANKTIGLVGLGDQDTYSETFAEGIFHIYEKAKAGKVVGQTPTDGYHFEASKAVEGGKFVGLVIDEDNQDDLTDERIAKWVEQVKGSFA

SEQ ID NO: 110 - protein, 429 aa, Mycobacterium tuberculosis H37Rv
MDNDGTIVDVTTHQLPWHTASHQRQRAFAQSAKLQDVLYEIRGPVHQHAARLEAEGHRILKLNIGNPAPFGFEAPDVIMRDIIQALPYAQGYSDSQGILSARRAVVTRYELVPGFPRFDVDDVYLGNGVSELITMTLQALLDNGDQVLIPSPDYPLWTASTSLAGGTPVHYLCDETQGWQPDIADLESKITERTKALVVINPNNPTGAVYSCEILTQMVDLARKHQLLLLADEIYDKILYDDAKHISLASIAPDMLCLTFNGLSKAYRVAGYRAGWLAITGPKEHASSFIEGIGLLANMRLCPNVPAQHAIQVALGGHQSIEDLVLPGGRLLEQRDIAWTKLNEIPGVSCVKPAGALYAFPRLDPEVYDIDDDEQLVLDLLLSEKILVTQGTGFNWPAPDHLRLVTLPWSRDLAAAIERLGNFLVSYRQ

SEQ ID NO: 111 - protein, 481 aa, Capsicum annuum
MDSITIDTINPKVLKCEYAVRGEIVTIAQKLQQDLKDNPGSHPFDEILYCNIGNPQSLAQQPITFFREVLALCDHPSILDKSETQGLFSADAIERAFQILDQIPGRATGAYSHSQGIKGLRDTIASGIEARDGFPADPNDLFLTDGASPAVHMMMQLLIRSQNDGILCPIPQYPLYSASIALHGGTLVPYYLDEQTGWGLEISELEHQLNTAKSNGIDVRALVVINPGNPTGQVLGEANQREIVEFCKKEGLVLLADEVYQENVYVPDKKFHSFKKITRSMGYGEKDISLVSFQSVSKGFYGECGKRGGYMEITGFSPEVREQIYKLASVNLCSNISGQILASLVMSPPKVGDESYESFSAEKEAVLSSLARRAQALQDALNSLEGVTCNRAEGAMYLFPRINLPDKAIKAAEVAKTAPDAFYAKLLLNATGIVVVPGSGFRQVPGTWHFRCTILPQEEKIPAIVSRLTEFHKKFMDEFCG

SEQ ID NO: 112 - protein, 896 aa, Saccharomyces cerevisiae
MTTTAQDNSPKKRQRIINCVTQLPYKIQLGESNDDWKISATTGNSALYSSLEYLQFDSTEYEQHVVGWTGEITRTERNLFTREAKEKPQDLDDDPLYLTKEQINGLTTTLQDHMKSDKEAKTDTTQTAPVTNNVHPVWLLRKNQSRWRNYAEKVIWPTFHYILNPSNEGEQEKNWWYDYVKFNEAYAQKIGEVYRKGDIIWIHDYYLLLLPQLLRMKFNDESIIIGYFHHAPWPSNEYFRCLPRRKQILDGLVGANRICFQNESFSRHFVSSCKRLLDATAKKSKNSSDSDQYQVSVYGGDVLVDSLPIGVNTTQILKDAFTKDIDSKVLSIKQAYQNKKIIIGRDRLDSVRGVVQKLRAFETFLAMYPEWRDQVVLIQVSSPTANRNSPQTIRLEQQVNELVNSINSEYGNLNFSPVQHYYMRIPKDVYLSLLRVADLCLITSVRDGMNTTALEYVTVKSHMSNFLCYGNPLILSEFSGSSNVLKDAIVVNPWDSVAVAKSINMALKLDKEEKSNLESKLWKEVPTIQDWTNKFLSSLKEKASSDDDVERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 113 - protein, 407 aa, Herminiimonas arsenicoxydans
MRPIQKSKKLADVCYDIRGPVLEKARQMEEDGHKIIKLNIGNLATFGFDAPDEIVQDMIRNLSNASGYTDSKGLFAPRKAIMQYSQEKKIAGVTIDDIYLGNGASELIVMSMNALLNTGDEVLVPSPDYPLWTAAVSLSGGTPVHYVCDEQADWFPDIDDIRKKINSNTKAIVVINPNNPTGALYPVELLQQIVDLAREHQLIVFADEIYDKVLYDGAKHDSIASLADDVLFITFNGLSKNYRACGYRAGWMIVSGEKRYAKDYIEGLNMLASMRLCANAPGQYAIQTALGGYQSINDLVGPGGRLTRQRDLAHKLLTEIPGVTCVKPKSALYMFPRLDPKMYPIKDDQDFAYQLLAEESVLIVQGTGFNCPTPDHFRVVFLPNSDDLTIAIGRIAHFLEGYRKRLG

SEQ ID NO: 114 - protein, 859 aa, Triticum aestivum
MKQRLLVVANRLPVSANRRGEDQWSLEISAGGLVSALLGVKDVDAKWIGWAGVNVPDEVGQQALTNALAEKRCIPVFLDEEIVHQYYNGYCNNILWPLFHYLGLPQEDRLATTRNFESQFDAYKRANQMFADVVYQHYQEGDVIWCHDYHLMFLPRCLKEHDINMKVGWFLHTPFPSSEIYRTLPSRSELLRSVLCADLVGFHTYDYARHFVSACTRILGLEGTPEGVEDQGKLTRVAAFPIGIDSDRFKRALDIDAAKRHVNELKQRFAGRKVMLGVDRLDMIKGIPQKILAFEKFLEENPEWIDKVVLLQIAVPTRTDVPEYQKLTSQVHEIVGRINGRFGTLSAVPIHHLDRSLDFHALCALYAVTDVALVTSLRDGMNLVSYEYVACQGSKKGVLILSEFAGAAQSLGAGAILVNPWNITEVADSIKHALTMTSDEREKRHRHNYAHVTTHTAQDWAETFVCELNDTVAEALMRTRQVPPDLPSRTAIQQYLQSKNRLLILGFNSTLTEPVESSGRRGGDQVKEMELKLHPDLKGPLRALCEDESTTVIVLSGSDRSVLDENFGEFNLWLAAEHGMFLRPTDGEWMTTMPEHLNMDWVDSAKHVFEYFTERTPRSHFEHRETSFVWNYKYADVEFGRLQARDMLQHLWTGPISNAAVDVVQGSRSVEVRSVGVTKGAAIDRILGEIVHSKSMVTPIDYVLCIGHFLGKDEDIYVFFDPEYPSEPKVKPDGASVSVDRRQNGRPSNGRSNSRNSQARTQKPQVAPPPPERSSSSSDHSTANNNSHHDWREGSSVLDLNGDNYFSCAVGRKRSNARYLLNSSEDVVSFLKEMAESTTPRAGGLPPGAAADYMFLDRQ

SEQ ID NO: 115 - protein, 441 aa, Thermoplasma acidophilum DSM 1728
MKYIVVSSRCPFSHDKAAGKEIIKENVGGVATALRRAMEKYGGTWICWGDGKLDGKYLDEDVGKYRIRRVMLSVPEKHGYYDLYSNRTLWPLFHYFRERVKYTDNGYEIYRRVNEKFTNMIVQSLSPEDVIWIHDYQLSLVPKMLRDRGITNRIIFTWHIPWVSKEMFETLPESRDIIDSLSRSDFITFHTETYRKNFTDLLDENSRAKSLVIPLGIDYRYFSKTRGTDIKSYALMDRKLIFSIDRLDYTKGLVNRVLSIEELLRRHPDLVGKFVYVMIVTPSRTTVSDYVAMKRELEMHIGRINGEFGSISWMPILYMYRKISDKMLVSYYKNADIALITPLIDGLNLVSKEFVASSDKGILILSRFAGASNCLDGAVVVNPNSLGEVAEAIYSAMNMGEDEIRERLRKMKEEVSRRDTDWWIRRINAIAKRKINDRTVT

SEQ ID NO: 116 - protein, 189 aa, Platanus x acerifolia
PQYPLYSATISLCGGSLVPYFLEETANWGLDINNIRQSVAQARSRGITVRAMVIINPGNPTGQCLGEASLKELLHFCFQENLALLADEVYQQNVYQDERPFISARKILMDMGPPISKEVQLVSYHTVSKGYWGECGQRGGYFEMTNIPPQTVDEIYKVASISLSPNVHGQIFLGLMVNPPQPGDISYQK

SEQ ID NO: 117 - protein, 533 aa, Gemmata obscuriglobus UQM 2246
MGWSKERLEEVARTRLGGAKLIVVANREPYIHRYATDGAVEWIRPAGGLTTALDPVMQACGGVWVAHGSGDADRAVTDPSGRVGVPPDDPNYVLRRVWLTPEQEDGYYYGAANGMLWPLCHQVFARPAFDPGHWDAYRRVNQTFADAVLEEAQGGPALVFIQDYHFALLPRLLKAARPDLVTAQFWHIPWPGPEKFLVCPWARDILDGLLGNDLMGFHTQHDCNHFLECVDRALECRIDRERFAVQRGGQATTVKPFPISVDPALADEYLGDDWAARAGAIRRRHGLGDRPLIVGVDRVDYTKGIPERLRAVDRVLHRHPELRGGFHFVQVGAPSRSSIPAYRDLTAEVNGLAARINREHGTAGWQPVVFLNAHHGPEDIFALYRDAAGCVVSSLHDGMNLVAKEFVTARADDRGVLVLSTFTGAARELTDAVLANPFDVDELADGLHAALTMPAAEQERRMRRMRAQVDDHNIYRWAGMLLSEVGKRVPDSPPPPAEKSEGEREPNKNLRAYGDEEAIARETYVTAMQLAGA

SEQ ID NO: 118 - protein, 518 aa, Lentinula edodes
MFYFSSFLLLGPIGGALAAIGPVTDLHIVNSFIQPDGFNRSGVLAEGVFPGPLITGNKGDNFQINVIDELTNGTMLLSTSIHWHGLFQKTTNWADGPAFVNQCPIAANDSFLYNFNVPDQAGTFWYHSHLSTQYCDGLRGPLVVYDPQDPYADLYDVDDDSTVITLADWYHVPAPQAGAVPTSDATLINGLGRSVNGPADAPFAVVNVVQGSRYRFRLVSISCDPNFLFSIDGHTFTVIEADGVNHEPIVADSIQIFAAQRYSFILTANQTADNYWIRANPNNGHTGFAGGINSAILRYSGAPVADPVTTQTSANLLQETSLVPRENPGAPGNATANGVDVDLNLVLSFVGGRFEINGVSFVPPTVPVLLQILSGATTAAELLPSGSVYTLPLNSVIQLSFNTVAVAAVGGPHPFHLHGHTFDVVRSAGSTEYNYINPPRRDVVSTGAATDNVTIRFTTDNAGPWFLHCHIDWHLEAGFAIVFAEDAPDVAAVNPVPDAWNQLCPTYDALTPAQLGGN

SEQ ID NO: 119 - protein, 515 aa, Coprinopsis cinerea okayama7#130
MASNSTGDLIIVSNRLPVTINKDANGEYHFKMSSGGLVSALSGFKKSLNFTWIGWPGFFIPVKDREIVDRRLKEEYSCQAVYLDDDVADRHYNGFSNSILWPLFHYHPGEMNFDEENWLAYRQANLQFAEAVRPHVKPGTMVWVQDYHLMLLPMLLRNLIDGESASFASEEFSKITQGISAEANLAPTRIPDVKIGFFLHTPFPSSEIYRILPVRREILLGVLYCDLIGFHTYDYARHFLSSCTRILNLPTMPNGVEFGGRLAHVGTFPIGIEPSSFIDNLKKQSVQDRITQLEQRFRGVKVIVGVDRLDYIKGVPQKLHALELFLTQHPEWIGKVVLVQLAVPSRQDVEEYQNLRSTVNELVGRINGRFGTVEFMPIHFMHKSLTFDELCALYAVSDVCLVSSTRDGMNLVSYEYIACQQARQGAMILSEFAGAAQSLNGSIVVNPWDSQQVADAIHEAVTMDAATRAENHRKLFKYVNKYSASFWGSSFIREMSKITPYNPPAEVNGKSEEAS

SEQ ID NO: 120 - protein, 533 aa, Lentinula edodes
MLPFVSLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDAYHNFSIDGHRLTVIEVDGENHEPATVDNIQIFPGQRYSFVLSATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLMPPGSVYTLPINKTIEINFFGNATPGGPHPFHLHGHSFDVVRSADNTTYNYKNPVRRDVTAVAIGNQTTIRFVTDNPGPWFLHCHIDLHLEFGLAVVMAEAPSLVKATDVTTPAWDELCPIYDSLTPAQLP

SEQ ID NO: 121 - protein, 505 aa, Lentinula edodes
MLPFVSLLAAELVCLVYGAEVIRDTTSYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVRRDVTSVAIGNQTTIRFVTDNPGPWFLHCLLLKPYRPSFGIRTCRRNG

SEQ ID NO: 122 - protein, 403 aa, Pseudomonas aeruginosa PAO1
MQVSKSNKLANVCYDIRGPVLKHAKRLEEEGHRILKLNIGNPAPFGFEAPEEILQDVIRNLPTAQGYSDSKGLFSARKAVMQYYQQKQVEGVGIEDIYLGNGVSELIVMSMQALLNNGDEVLIPAPDYPLWTAAVSLAGGKPVHYLCDEQANWWPDLEDIKAKITPNTRAMVIINPNNPTGAVYSREVLEGMVELARQHNLVLFSDEIYDKILYDGAVHVSTASLAPDVLCLTFNGLSKSYRVAGFRSGWVAISGPKQRAQSYIEGLDILANMRLCANVPAQHAIQTALGGYQSINDLVLPPGRLLEQRNRAWELLNDIPGVSCVKPMGALYAFPRIDPKVCPIHNDEKFVLDLLLSEKLLIVQGTAFNWPWPDHFRVVTLPRVDDLEQAILRIGSFLKGYQQ

SEQ ID NO: 123 - protein, 195 aa, Triticum aestivum
  misc_feature (157)..(157): Xaa can be any naturally occurring amino acid
  misc_feature (166)..(166): Xaa can be any naturally occurring amino acid
MMGRKALDYEELNENVKKVQYAVRGELYLRASELQKEGKRIIFTFFFNPHALGQKPLTFPRHAVALWEGPFLLDDPNVGLIFPADAIARAKHYLSLAPGGLGAYSDSRGIPGVRQEVAEFIQRRDGYPSDPELIYLTDGASKGVMRMLHGLFRNERXGILGPVPPXPLYSAAIFPLGWFSLSPNYLGKRKLPWGH

SEQ ID NO: 124 - protein, 169 aa, Synechococcus sp.
AKIGLFYGTQTGVTQTIAESIQQEFGGESIVDLNDIANADASDLNAYDYLIIGCPTWGVGELQSDWEGIYDDLDSVNFQGKKVAYFGAGDQVGYSDNFQDAMGILEEKISSLGSQTVGYWPIEGYDFNESKAVRNNQFVGLAIDEDNQPDLTKNRIKTWVSQLKSEFGL

SEQ ID NO: 125 - protein, 457 aa, Zea mays
  misc_feature (262)..(262): Xaa can be any naturally occurring amino acid
  misc_feature (270)..(271): Xaa can be any naturally occurring amino acid
  misc_feature (276)..(276): Xaa can be any naturally occurring amino acid
  misc_feature (282)..(282): Xaa can be any naturally occurring amino acid
  misc_feature (290)..(291): Xaa can be any naturally occurring amino acid
  misc_feature (299)..(299): Xaa can be any naturally occurring amino acid
  misc_feature (302)..(302): Xaa can be any naturally occurring amino acid
  misc_feature (307)..(307): Xaa can be any naturally occurring amino acid
  misc_feature (309)..(309): Xaa can be any naturally occurring amino acid
  misc_feature (316)..(316): Xaa can be any naturally occurring amino acid
  misc_feature (322)..(322): Xaa can be any naturally occurring amino acid
  misc_feature (330)..(330): Xaa can be any naturally occurring amino acid
  misc_feature (337)..(337): Xaa can be any naturally occurring amino acid
  misc_feature (343)..(343): Xaa can be any naturally occurring amino acid
  misc_feature (351)..(352): Xaa can be any naturally occurring amino acid
  misc_feature (356)..(356): Xaa can be any naturally occurring amino acid
  misc_feature (361)..(362): Xaa can be any naturally occurring amino acid
  misc_feature (367)..(367): Xaa can be any naturally occurring amino acid
MARRRPMDYEELNEKVKKAQYAVRGELYLRASQLQKEGKKIIFTNVGNPHALGQKPLTFPRQVVALCQAPFLLDDPNVGLMFPPDAIVRAKRYLAMAPGGLGAYSDARGIPGIRKEVADFIHKRDGYPSDPELIYLTDGASKGVMQMLNAIIRNERDGILVPVPQYPLYSAIISLFGGSLVPYYLEEEANWNLDFANIRQAVAEARSKGITVRATVIINPGNPTGQCLSEANIRELVRYCYHENLVLLADEVYQQNVYQDEXPFISARKXXFDMGXPISREXQLFSFHTXXKGYWGEFXQRXGYFEXTXLPPKTVXEIYKVXSIVLSPNXPGQIFQXILESFXRRARIKTXXFNSXRNVGXXFTEGXMYSFPQIQLPARAIEAAKRAGKAADVFYCLKLLEATGISTVPGSGFGQKEGVFHLRTTILPAEEDFPTIMSSFKKFNDSFMEQYEGYSRM

SEQ ID NO: 126 - protein, 169 aa, Synechococcus sp.
AKIGLFYGTQTGVTQTIAESIQQEFGGESIVDLNDIANADASDLNAYDYLIIGCPTWNVGELQSDWEGIYDDLDSVNFQGKKVAYFGAGDQVGYSDNFQNAMGILEEKISSLGSQTVGYWPIEGYDFNESKAVRNNQFVGLAIDEDNQPDLTKNRIKTWVSQLKSEFGL

SEQ ID NO: 127 - protein, 500 aa, Mycobacterium bovis AF2122/97
MAPSGGQEAQICDSETFGDSDFVVVANRLPVDLERLPDGSTTWKRSPGGLVTALEPVLRRRRGAWVGWPGVNDDGAEPDLHVLDGPIIQDELELHPVRLSTTDIAQYYEGFSNATLWPLYHDVIVKPLYHREWWDRYVDVNQRFAEAASRAAAHGATVWVQDYQLQLVPKMLRMLRPDLTIGFFLHIPFPPVELFMQMPWRTEIIQGLLGADLVGFHLPGGAQNFLILSRRLVGTDTSRGTVGVRSRFGAAVLGSRTIRVGAFPISVDSGALDHAARDRNIRRRAREIRTELGNPRKILLGVDRLDYTKGIDVRLKAFSELLAEGRVKRDDTVLVQLATPSRERVESYQTLRNDIERQVGHINGEYGEVGHPVVHYLHRPAPRDELIAFFVASDVMLVTPLRDGMNLVAKEYVACRSDLGGALVLSEFTGAAAELRHAYLVNPHDLEGVKDGIEEALNQTEEAGRRRMRSLRRQVLAHDVDRWAQSFLDALAGAHPRGQG

SEQ ID NO: 128 - protein, 726 aa, Crocosphaera watsonii WH 8501
MSKTIIVSNRLPVKIERNQAGEFEYKTSEGGLATGLGSVYKEGDNIWVGWPGLAVNKTEDKEEICSRLKESNMSPVFLTKNEIEEYYEGFSNETLWPNFHYFNQYAVYSDVFWNTYKKVNKKFAKKLEEIIEDGDKIWIHDYQLLVLPAMIRETHPNSSIGFFLHIPFPSYESFRLLPWRTDLLTGMLGADFIGFHTYDYVRHFLSSVNRLVGITDNDGHMNVGNRLAMADAIPMGIDYNRYAQAAADPETLASEVKYRISLGDVKLILSIDRLDYSKGIPQRLRAFEQFIEENEEFREEVSLLILVVPSRDQVPMYANLKKEIELLVGSINGKFGTINWRPIHYFYRSYPLHSLSAFYRMSHVALVTPLRDGMNLVCKEFVASKLDKKGVLILSETAGSAKELSDAILINPNDTNQMVEAMKEALKMPEEEQIARMETMQKSLKRYDINAWVKLFMKGLEQVKEEQENLRTKPISSVVKNKLLQEYRSSKKRIIFLDYDGTLVGFYANPNDSVPDAELEELMTKLTADTNNQVVVISGRGRDFLEKWLSKFNVDFIAEHGVWHKENGKEWECFVELDTSWQEEFDRVLEMYVDRTPGSFIERKDFSMVWHYRKVEPGLGELRSRELANLLKYLSADKDLQVQEGDMVIEIKNARVNKGVAAASWLKKNDYDFSFACGDDWTDEDTFKAMPEDAFTVKVGSSSSAAKYRVENFKDIRKLLLSLANQ

SEQ ID NO: 129 - protein, 528 aa, Trametes trogii
MSKFQSLAAFIALSLSTGRLAAAAIGPTADLTISNANISPDGFTRAAVVANNQFPGPLITGNKGDTFQLNVIDNLTNDTMLTATTIHWHGFFQKGTNWADGPAFVNQCPISEGNSFLYDFAAPGQAGTFWYHSHLSTQYCDGLRGVMVVYDPNDPHKSLYDVDDESTVITLADWYHTAARLGPRFPFGADTVLINGLGRFATGDPDAELAVITVTKGKRYRFRLANISCDPNFTFSIQGHTMNVIEVDSVNVTPYEVDAIQTFAGQRYSFVLTVDQDIDNYWMWAIPNIGTINTDGGVNSAILRYDGAAEVEPDAASPSPSNQLVERNIVPLTDLAAPGNPTVGGVDYALNLDFSFDGANFAINGESYTSPSVPVLLQILSGAQTAPDLLPGGSVYVLPSNATIELSFPMTASNAPGGPHPFHLHGHTFHVVRSAGQTDYNYVNPPQRDTVSVGAAGDNVTIRFRTDNPGPWFLHCHIDFHLEAGFAVVFAEDTPNVASANKPSAAWEDLCPTYNSVYPNGDNGDARR

SEQ ID NO: 130 - protein, 495 aa, Saccharomyces cerevisiae
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWFGYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 131 - protein, 176 aa, Synechococcus sp. PCC 7335
MANIGIFYGSTSGVTEEIAEKIQAEIGEDLCDLYSMEEDFDDVDDLLKYDYLLLGCSTWGAGEVQNDWREPLFDMEIDKPDFSGKTIAIFGAGDCTGHGKHFVGALGTLYDQFKALGAKLVGAVSAEDYSFEHSSSIRDGKFVGLPLDEVNESDKTDQRITDWLALLSNDIPALAT

SEQ ID NO: 132 - protein, 181 aa, Idiomarina loihiensis L2TR
MTEVVIMSLEIGLFYGSTTCYTEIAAEKIQQAIGEDIVQLFDIKNTPLKEAEQFDILIFGISTWDFGELQEDWESHWDDINDVNLRGKVVALFGMGDQEGYTDWFQDALGMLHDAIANHGCKRIGFWPNQGYEFAASKALTADNTQFVGLSLDEDSQYELSDERIEQWTTQILEEIAEQLG

SEQ ID NO: 133 - protein, 489 aa, Debaryomyces hansenii CBS767
MFKRFVSFKAAGKLKLADLNKLTINAKYAVRGKIPIRADELKEQLNDTNNELPFKEIIYANIGNPQQLDQAPLTWYRQVLSVLQNPKLLNSQIDYPKDVIDRAKILLENVGSVGAYSHSQGTPHVRKSVADFITRRDGFPSNSSDIFLTSGASAAVSYLLQVLSSSDRSGFLIPIPQYPLYTATIALNDAVPIGYYLNEENNWSTNPTQIRELIKENNEKGIQIKALVVINPGNPTGSILSYDNIVEIINIAAEHGIAIIADEVYQENVFEGEFVSVKKVLSKLNRLDPQAYNNVQLASLHSTSKGVSGECGQRGGYMELVGFSKEVRDIIFKLASINLCSVVSGQTLMELMINPPTPESPSYELYKSETSKIHKSLQSRADLLYKSFIEMEGITCNKPMGAMYLFPKLNFTPNSYSKLFEASENIGATIDEVYCIELLENTGICCIPGSGFGQVPDTYHLRTTFLPPGSKWIDRWVEFHNDFIAKYKN

SEQ ID NO: 134 - protein, 602 aa, Arabidopsis thaliana; identical to SEQ ID NO: 105

SEQ ID NO: 135 - protein, 580 aa, Sclerotinia minor
MKCFTSLTALTAIFAQASASAIPAIRSPATSHQKVTASCAHSATSRSCWGAYSIDTDWYDVIPHTGVTREYWLSVENSTITPDGYTRSAMTINGTVPGPAIIADWGDNLVIHVTNNLQHNGTAIHFHGIRQKGSLEYDGVPGVTQCPIAPGDTLTYKFQATQYGTTWYHSHFSLQYADGLFGPLIINGPATADYDEDLGVMFLGDWAHETVFDLWDRARSGPPISLPNTLMNGTNSCECDTSDPQCVGGGKKFEAVFVEGQKYRIRLINVGIDSHFEFAIDGHTLTVIANDLVPIVPYTTETLLIGIGQRYDVIVEANAKPNNYWIRANWGTACSSNLRAANATGILRYNSSSTAEPTSVGATPRGTCGDEPLASLVPHLAMDVGDYALMDEKLNWILGNVITWTINSSSLVLDWTNPTTLQVFRNESIFPTDYNVVPISKEITNSDWVVYVIEDLTTAGTWHPMHLHGHDFFIVGQEQAVFDPVNTPSTFNLKNPPRRDVAALPAGGYLAIAFKLDNPGSWLLHCHIAWHASEGLAMQFVESESSIAIGMKDTQIFDNTCKNWNAYVPTEVFPQDDSGI

SEQ ID NO: 136 - protein, 482 aa, Triticum aestivum
MAATVAVDNLNPKVLKCEYAVRGEIVIHAQRLQQQLQTQPGSLPFDEILYCNIGNPQSLGQQPVTFFREVLALCDHPDLLKKEEIKTLFSADSISRAKQILALIPGRATGAYSHSQGIKGLRDAIASGIASRDGFPANADDIFLTDGASPGVHLMMQLLIRNEKDGILVPIPQYPLYSASIALHGGSLVPYYLNESTGWGLEISDVKKQLEDARSRGIDVRALVVINPGNPTGQVLAEENQYDIVKFCKNEGLVLLADEVYQENIYADNKKFHSFKKIVRSLGYGEEDLPLVSYQSVSKGYYGECGKRGGYMEITGFSAPVREQIYKIASVNLCSNITGQILASLVMNPPKASDESYASYKAEKDGILASLARRAKALEVAFSKLEGITCNKAEGAMYLFPQICLPQKAIEAAKAANKAPDAFYALRLLESTGIVVVPGSGFGQVPGTWHFRCTILPQEEKIPAIISRFTVFHETFMAEYRD

SEQ ID NO: 137 - protein, 896 aa, Saccharomyces cerevisiae
MTTTAQDNSPKKRQRIINCVTQLPYKIQLGESNDDWKISATTGNSALFSSLEYLQFDSTEYEQHVVGWTGEITRTERNLFTREAKEKPQDLDDDPLYLTKEQINGLTTTLQDHMKSDKEAKTDTTQTAPVTNNVHPVWLLRKNQSRWRNYAEKVIWPTFHYILNPSNEGEQEKNWWYDYVKFNEAYAQKIGEVYRKGDIIWIHDYYLLLLPQLLRMKFNDESIIIGYFHHAPWPSNEYFRCLPRRKQILDGLVGANRICFQNESFSRHFVSSCKRLLDATAKKSKNSSNSDQYQVSVYGGDVLVDSLPIGVNTTQILKDAFTKDIDSKVLSIKQAYQNKKIIIGRDRLDSVRGVVQKLRAFETFLAMYPEWRDQVVLIQVSSPTANRNSPQTIRLEQQVNELVNSINSEYGNLNFSPVQHYYMRIPKDVYLSLLRVADLCLITSVRDGMNTTALEYVTVKSHMSNFLCYGNPLILSEFSGSSNVLKDAIVVNPWDSVAVAKSINMALKLDKEEKSNLESKLWKEVPTIQDWTNKFLSSLKEQASSNDDMERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 138 - protein, 800 aa, Yarrowia lipolytica CLIB122
MLPEIITPTAARALNVPISGRVINCVTTLPYEIYREGATYKIRPRRGNSALYSALDYMQSGDGDTTWTSSLVAWTGEIALPAATSLPDLELYQKLTEQDKHMLERELTEAQGGTPTHPIWTDSGDTVSTGYNEQLSPTRRYAENILWPILHYIQGEPTDGRDEKKWWSDYEDLNRKYCDKVLDIYNEGDVIWIHDYYLFLLPKMIREKLPDARIGFFMHAPFPSSEYFRCLAKRQELLQGVLASNLISTQSEAHKRHFMSACSRIVGAETATPTSVYAYGQSVSVVALPIGIDTAKVEADAFTDEITEKVRAIRQLYPDKKIIVGRDRLDSVRGVVQKLYAFDVFLKRYPEWRDRVVLVQVTSHTATGTRKVEKKVAELVSSINGRYGAIHFSPVHHYTKHIAREEYLALLRVADLCLITSVRDGMNTTALEFIVCQNGNNSPLILSEFTGSAGNLPGAILVNPWDAVGVAEQINRTFRMGQDEKLAIEQPLYQRVTANTVQHWVNRFVSQVISNTFRTDQSHLTPILDNHKLVERFKMAKKRVFLFDYDGTLTPIVTDPAAATPSDGLKRDLRALAKDPRNAIWIISGRDSTFLDKWLGDIAELGMSAEHGCFMKNPGTTDWENLAANFDMSWQKDVNDIFQYYTERTQGSHIERKRVALTWHYRRADPEFGLFQARECRAHLEQAVVPKWDVEVMSGKANLEVRPKSVNKGEIVKRLISEYSSEGRPPQFVLCMGDDQTDEDMFKALKDVPDLDSESIFPVMIGPPEKKTTASWHLLEPKGVLETLNELAKLEGESKM

SEQ ID NO: 139 - protein, 115 aa, Zea mays
  misc_feature (38)..(38): Xaa can be any naturally occurring amino acid
  misc_feature (71)..(71): Xaa can be any naturally occurring amino acid
  misc_feature (89)..(89): Xaa can be any naturally occurring amino acid
LGPSRPAGFNSSPKLLCGISPEGAMYLFPPIRVPPRAXEAARRVGRSADGFYCLKLLEATGISTGPASAFXGEKEGVFHLRTTILPAEXDLPAMMARFEKLNDCLMEEDEGYSMM

SEQ ID NO: 140 - protein, 482 aa, Zea mays
MAPSVAVENLNPKVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDAIAAGITSRDGFPANADDIFITDGASPGVHMMMQLLIRNEKDGILCPIPQYPLYSASIALHGGALVPYYLDEKTGWGLEISDLKKQLEDARSKGIDVRALVVINPGNPTGQVLAEDNQYDIVKFCKNEGLVLLADEVYQENIYVDNKKFNSFKKIARSMGYGEDDLPLVSFQSVSKGYYGECGKRGGYMEITGFSAPVREQIYKVASVNLCSNITGQILASLVMNPPKVGDESYASYKAEKDGILQSLARRAKALEDAFNTLEGFSCNKAEGAMYLFPQIHLPHKAIEAAKAAKKAPDAFYALRLLESTGIVVVPGSGFGQVPGTWHVRCTILPQEDKIPAVITRFKAFHEAFMAEYRD

SEQ ID NO: 141 - protein, 160 aa, Zea mays
RDRSTSSSRQMELHYINTGFPYTITESFMDFFEGLTYAHADFALMDGFQDQGNPYWTMMHTNSYKYGYSGSGNYYSYAHAYDIDDYMHRTDGGRRTWDNTTPVNNVDSANVVLQDGEAPRTTANTTSEDCLDSEELILWISYPMMSTEYGITLHILSPGN

SEQ ID NO: 142 - protein, 173 aa, Escherichia coli O157:H7 EDL933
MNMGLFYGSSTCYTEMAAEKIRDIIGPELVTLHNLKDDSPKLMEQYDVLILGIPTWDFGEIQEDWEAVWDQLDDLNLEGKIVALYGLGDQLGYGEWFLDALGMLHDKLSTKGVKFVGYWPTEGYEFTSPKPVIADGQLFVGLALDETNQYDLSDERIQSWCEQILNEMAEHYA

SEQ ID NO: 143 - protein, 563 aa, Cleome spinosa
MAIHYNANVESAGITRHYKFNIQLKNVTRLCKTRSILTVNGEFPGPRVIAREGDNLLIKVVNHVSTNISIHWHGIRQLRSGWADGPAYITQCPIQTGQSYVYNFTVTGQRGTLWWHAHITWIRATVYGPLIILPKLNDSFPFPKPYKQIPIIFGEWFNADPQAVLQQALQTGAGPNASDAHTINGLPGPLYNCSTNDTYKLKVKPRKTYLLRLINAALNDELFFSIANHTLTVVEADASYVKPFQTDVLVIGPGQTTNVLLRTKRVSPNATFFMLARTYFVGQGTIDNTTVAGILEYKQNLRCNGSNSLKTKPVLMPTLPPINATSFVSNFTNMFRSLASPRFPIDVPKTVDRKFLFTVGLGTNPCPENQTCQGPNGTMFSASMNNVSFVLPNTTSLLQSYFFGKSNGVFTTDFPNAPIFEFNYTGMPPNNTMVMNGTKLVVLKYNTTVELVLQDTSILGSESHPMHLHGFDFYVVGQGFGNFDPTRDPKRFNLLDPVERNTAFVPAGGWVAVRFRADNPGVWLMHCHIEIHLSWGMTMAWLVLDGDLPNQKLPPPPSDFPKC

SEQ ID NO: 144 - protein, 169 aa, Synechococcus sp.
AKIGLFYGTQTGVTQTIAESIQQEFGGESIVDLNDIANADASDLNAYDYLIIGCPTWNVGELQSDWEGIYDDLDSVNFQGKKVAYFGAGDQVGYSDNFQDAMGILEEKISSLGSQTVGYWPIEGYDFNESKAVRNNQFVGLAIDEDNQPDLTKNRIKTWVSQLKSEFGL

SEQ ID NO: 145 - protein, 489 aa, Debaryomyces hansenii
MFKRFVSFKAAGKLKLADLNKSTINAKYAVRGKIPIRADELKEQLNDTNNELPFKEIIYANIGNPQQLDQAPLTWYRQVLSVLQNPKLLNSQIDYPKDVIDRAKILLENVGSVGAYSHSQGTPHVRKSVADFITRRDGFPSNSSDIFLTSGASAAVSYLLQVLSSSDRSGFLIPIPQYPLYTATIALNDAVPIGYYLNEENNWSTNPTQIRELIKENNEKGIQIKALVVINPGNPTGSILSYDNIVEIINIAAEHGIAIIADEVYQENVFEGEFVSVKKVLSKLNRLDPQAYNNVQLASLHSTSKGVSGECGQRGGYMELVGFSKEVRDIIFKLASINLCSVVSGQTLMELMINPPTPESPSYELYKSETSKIHKSLQSRADLLYKSFIEMEGITCNKPMGAMYLFPKLNFTPNSYSKLFEASENIGATIDEVYCIELLENTGICCIPGSGFGQVPDTYHLRTTFLPPGSKWIDRWVEFHNDFIAKYKN

SEQ ID NO: 146 - protein, 177 aa, Vibrio vulnificus CMCP6
MASVGIFFGSDTGNTEAVAKMIQKQLGKKLVHVQDIAKSSKEDIDNFDLLLLGIPTWYYGEAQCDWDDFFPELEKIDFSTKLVAIFGCGDQEDYAEYFCDAMGTVRDIVEAKGGTILGHTSTESYEFEASKALVAGDDRLFVGLCIDEDRQPELTEERVKNWVEQIYEEMCLAELED

SEQ ID NO: 147 - protein, 463 aa, Cupriavidus taiwanensis
MPRLVAVSNRVADPRNVAAGGLAVALSEALRQTGGLWFGWSGKALQTAQGGTPGEGDLHLQQAGNVTLATVDLSREDHDAYYLGYSNGVLWPVFHYRLDLADFDSNFLNGYRRVNQLFARKLAPLLQPDDIIWIHDYHLIPLASELRAIGCGQKIGFFLHVPLPPPLILAAIPQHEWLMRALFAYDLLGFQSHADVEHFSRYVQAEAQAEPMGEHRYRAFHRTVRAQAFPIGIDVDEFMELGRGEEAQETYEMMCAQYARRRLLLGIDRLDYSKGLPQRLKAFYRLLAEYPENRSSATLVQIAAPSRESVDAYADLRREMEQLSGSINGEFGELDWMPVRYIHRTTARKRLPGLCRASRVALVTPLRDGMNLVAKEFIAAQDPEDPGVLVLSRFAGAAEQLREALLVNPYDTRATAQAIQQALHMPLAERHQRHQKLLERIRAQDVHWWSREYLRALSETEGA

SEQ ID NO: 148 - protein, 169 aa, Synechococcus sp.
AKIGLFYGTQTGVTQTIAESIQQEFGGESIVDLNDIANADASDLNAYDYLIIGCPTWNVGELQSDWEGIYDDLDSVNFQGKKVAYFGAGNQVGYSDNFQDAMGILEEKISSLGSQTVGYWPIEGYDFNESKAVRNNQFVGLAIDEDNQPDLTKNRIKTWVSQLKSEFGL

SEQ ID NO: 149 - protein, 394 aa, Pelargonium x hortorum
YFDGWKAYDRDPFHPSQNPNGVIQMGLAENQLSSDLIEDWVRSNPEASICTLEGVGKFKDVANFQDYHGLLEFRHAVAKFMSRGRGGKVTFDPHRVVMSAGATGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFVAPEFVSVSEILQEMDDTTCNPDLIHIVYSLSKDLGMPGFRVGIVYSFNDDVVSCARKMSSFGLVSTQTQHLLAAMLSDDVFVERFLAETRRRLGRRHGVFTKGLEELGIGCLKSNAGLYFWMDLRKLLEEETFEAEMVLWKVIINEVKLNVLLGSSFHCVGPGWFRVCFANMD

SEQ ID NO: 150 - protein, 443 aa, Bradyrhizobium sp. BTAi1
MRDGAQMEPIAQIEQLGQGALALLDLPAAHYAGYYEGFANSALWPALHSRSDLISVSHDDYRSYREVNAFVARALLRFHKPETLFWIQDYHFLSLGVELRTLGVKSPIGFFLHTPWPARSVIDSVPNHRDLVTAMLAYDLIGFQTEDDRDNFCACIRADLGLQVRDGVVKSRHGRTRLAVFPIGIDADKFAASAAKAASHPDVSRLRRSLHGEKLAIGVDRLDYSKGLVNRITAFDRMWTMHPTLLRAASLLQIATPSRESIEAYGNLQSDVARLVSEVNGRHGEADWTPIRYLNKGYGQGVLSGLYRSAQVGVVTPLHDGMNLVAKEYVAAQSPVDPGVLVLSKFAGAANELDAALLVNPHDIDGMARTIAMALSMPLNERRMRYEIMMTKLRRHSIQQWFTDFLEALQDSDAPETAEIAPLPTAPAGLLSSRLASSSARYH

SEQ ID NO: 151 - protein, 503 aa, Cyanothece sp. ATCC 51142
MKSSLVILYHREPYDEVVENGQVRYLPKKSPNGIVPTLKSFFADDNNQGTWIAWKQVSPEQKNQFNKNVVVEDDGNYRVSRIPLTAEQVRDFYHVTSKEAFWPILHSFPYHFTSESSNWDNFVKINRLFAEAACEEAADDALIWVHDYNLWLAPQFIREKKPDARIAFFHHTPFPSVDIFNILPWREAIVDSLLCCDVVGFHIPRYSENFVNVARSLRPIDIVEKTKVTGHITPVGIALAEPEATTKLKYKNQIVKVDAFPVGTSPQNILDVLRTPEAEAKVAEIKETLQGRKLIIAAGRVDYVKGNKEKLEAFERLLERRPELHGKVNFIMTCVQAATGMQVYQEAQREIEYLVGKINGRFAKFDWIPIRLSTQPIPLLDLFCYYRAADICWTTPLRDGLNLVAKEYIVAHEGKDGVLVLSEFVGAATELPQAILTNPYSIKLMDEAIDQALDMSPEEQQEKMAKMYETVTKYDVKYWSDRLLNYFAKMTREFVDDKEPALN

SEQ ID NO: 152 - protein, 180 aa, Azotobacter vinelandii
MAKIGLFFGSNTGKTRKVAKSIKKRFDDETMSDALNVNRVSAEDFAQYQFLILGTPTLGEGELPGLSSDCENESWEEFLPKIEGLDFSGKTVALFGLGDQVGYPENYLDALGELYSFFKDRGAKIVGSWSTDGYEFESSEAVVDGKFVGLALDLDNQSGKTDERVAAWLAQIAPEFGLSL

SEQ ID NO: 153 - protein, 446 aa, Coprinopsis cinerea
  misc_feature (191)..(191): Xaa can be any naturally occurring amino acid
LLSFALLAISVANAQIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVVYDDNDPHAALYDEDDENTIITLADWYHIPAPSIQGAAQPDATLINGKGRYXGGPAAELSIVNVEQGKKYRMRLISLSCDPNWQFSIDGHELTIIEVDGRLTEPHTVDRLQIFTGQRYSFVLDANQPVDNYWIRAQPNKGRNGLAGTFANGVNSAILRYAGAANADPTTSANPNPVQLNEADLHALIDPAAPGIPTPGAADVNLRFQLGFSGGRFTINGTAYESPSVPTLLQIMSGAQSVNDLLPAGSVYELPRNQVVELVVPAGVLGGPHPFHLHGHAFSVVRSAGSSTYNFVNPVKRDVVSLGVT

SEQ ID NO: 154 - protein, 516 aa, Flammulina velutipes
MSRSLTAFITLSLLVLRSFAGIGPITDLVIANADVAPDGFTRTAALSGGTVNGALITGSRGDNFQINVVNNLNDNNILQSTSIHWHGMFMAGTSWADGPAFVNQCPIAKSNSFVYDFTALEQAGTFWYHSHLSSQYCDGIRGPMVIYDPDDPHAALYDVDNDDTVITLADWYHAFAKTLAFPTPDSTLINGLGRWAEDPTSDLAVINVEAGVRYRFRLVSMSCDPNFVFAIQGHTLNIIEADGVSTEPIEVDQITIFAGQRYSFVLTAEQAVDNYWIRAEPTPGPTGFEDGINSAILRYSGAAEAEPTDDTVESTNPLDENALVPLENPGADGTAEVGADDVFAINLALAFDLSTFKFTVNGATFEPPTTPVLLQLLSGAQTADTLLPAGSLFTLPANRVVELSIPSEGLIGGPHPFHLHGHVFDVIRGPGQTDYNFENPPRRDVVSIGAAGDNVTIRFTTDNPGPWFLHCHIDWHLEAGLALVFAEDTDNWDVSTPPTSWDELCPIYDALSEDDL

SEQ ID NO: 155 - protein, 994 aa, Selaginella lepidophylla
MPQPYPSSSSTSNAKEAGGGAAAAGGGGGGAFSLPPSLASSRVERLVRERQLRNQRQEDEPEDEQQALEAEEAAVAATEVPDAVAAATPSLSDEPSKISSGRGQRLLVVANRLPLSATRKGETEWNLEMSAGGLVSALLGVKQFEVTWIGWPGVYVQDEKGEKSLRGALEEKGFVPVLLDEATVDQYYNGYCNNVLWPLFHYIGLRQEDRLAATRSLLSQFNAYKRANRLFAEAVFNFYQEGDVVWCHDYHLMFLPSYLKEKDSQMKVGWFLHTPFPSSEIYRTLPLRAELLQGVLAADLVGFHTYDYARHFVSACTRILGLEGTPEGVEDQGKNTRVAAFPVGIDSERFIEAVETDAVKKHMQELSQRFAGRKVMLGVDRLDMIKGIPQKLLAFEKFLEENSEWRDKVVLVQIAVPTRTDVLEYQKLTSQVHEIVGRINGRFGSLTAVPIHHLDRSMKFPELCALYAITDVLLVTSLRDGMNLVSYEFVACQKDKKGALILSEFAGAAQSLGAGSILINPWNIIESSNAIADALNMPEEEREERHRHNFMHITTHSAQVWAETFISELNDSILEAELRTLHIPPQLPLDKAVAKYSESKNRLVILGFNSTLTAQVEAPRGRAPDQIREMKIRLHPSIKDILNVLCSDPKTTIVILSGSERVALDEVFGEFDLWLAAENGMFLRHTQGEWMTTMPEHLNMDWLESVQLVFDYFCERTPRSFVETRETSLVWNYKYADVEFGRVQARDMLQHLWTGPISNAAVDVVQGGKSVEVRPVGVSKGSAIDRILGEIVHSKHMTIPIDYVLCIGHFLSKDEDIYTFFEPELPLLDRDSSTSNGGKPLGGKLPIDRKSSKSSSRMKPPVSSPKSPGRGSEQQQQAEEASRWEGSSVLDLQGENYFSCAVGTMKRSLARYCLTSSEEVVTFLTSLTSTVAAAAGAGAGARATGSGAAGAGAGAGAGGDHEAPGSPIRKSDSFKTSGWHSPTPRSPKLAPAVQ

SEQ ID NO: 156 - protein, 469 aa, Arabidopsis thaliana
VIKCEYAVRGEIVNIAQKLQEDLKTNKDAYPFDEIIYCNIGNPQSLGQQPITFFREVLALCSYTALLDESATHGLFSSDSIERAWKILDQIPGRATGAYSHSQGIKGLRDAIADGIEARDGFPADPNDIFMTDGASPGVHMMMQLLITSEKDGILCPIPQYPLYSASIALHGGTLVPYYLDEASGWGLEISELKKQLEDARSKGITVRALAVINPGNPTGQVLSEENQRDVVKFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 157 - protein, 567 aa, Arabidopsis thaliana
MEGVRVPIACALILLAISSITSASIVEHTFNVQNLTVSRLCKRQVITVVNGSLPGPTIRVKEGDSLVIHVLNHSPHNITIHWHGIFHKLTVWADGPSMITQCPIQPGQRYAYRFNITGQEGTLWWHAHASFLRATVYGALVIRPKSGHSYPFPKPHKEVPILFGEWWNTDVVALEEAAIATGVPPNNSDAYTINGRPGNLYPCSKDRMFSLNVVKGKRYLLRIINAAMNIQLFFKIANHRLTVVAADAVYTAPYVTDVIVIAPGQTIDALLFADQSVDTSYYMAAHPYASAPAVPFPNTTTRGVIHYGGASKTGRSKPVLMPKLPSFFDTLTAYRFYSNLTALVNGPHWVPVPRYVDEEMLVTIGLGLEACADNTTCPKFSASMSNHSFVLPKKLSILEAVFHDVKGIFTADFPDQPPVKFDYTNPNVTQTNPGLLFTQKSTSAKILKFNTTVEVVLQNHALIAAESHPMHLHGFNFHVLAQGFGNYDPSRDRSKLNLVDPQSRNTLAVPVGGWAVIRFTANNPGAWIFHCHIDVHLPFGLGMIFVVKNGPTKSTTLPPPPPDLPKC

SEQ ID NO: 158 - protein, 483 aa, Amanita muscaria
MSSGGLVSALSGFKKSLNFTWIGWPGFFIPPKDRPLVNKRLMDQYSCQAVYLDDDVADKHYNGFSYSILWPLFHYHPGEMNFDEENWLAYRQANLQFAEAVLQQLTPGAMVWVQDYHLMLLPMLLRGLIEGRDLGADLSITELSEIGEGAEEGIQNAKNLHGVKMGFFLHTPFPSSEIYRILPVRREILLGILYCDLIGFHTYDYARHFLSSCTRILGLPTMPNGVEFEGRMAHVGTFPIGIEPSSFIENLKKDSVTARITQLEHRFNGVKVIVGVDRLDYIKGVPQKLHALELFLTQHPEWIGKVVLVQLAVPSRQDVEEYQNLRSTVNELVGRINGRFGTVEFMPIHFMHKSLPFDELCALYAVSDVCLVSSTRDGMNLVSYEYVACQQARQGVMILSEFAGAAQSLNGSIVVNPWDSQQVADAIHEAVTMDAPTRSENHKKLFKYVNKYSAAFWGSSFIKEMARIKAIEVNKGAKEDAAV

SEQ ID NO: 159 - protein, 516 aa, Coprinopsis cinerea
MQLLAFVLAALPLARAAIGPVGNLVIANANVSPDGFVRSAVLAGATGTSLEHPGPVIVGQKGDTFHINVIDDLTDPTMLRTTSIHWHGFLQEGTAWADGPAGVTQCPIAPGHSFLYKFQAKNQAGTFWYHSHHMSQYCDGLRGVMVVYDPLDPHRHLFDVDNEDTIITLADWYHDPAPSAGLVPTPWSTLINGKGRYPGGPVVPLAVIHVSRGKRYRFRLVSLSCDPNYVFSIDGHTMTVIEVDGVNHEPLVVDHIQIFAGQRYSFVLNANRPVNNYWVRANPNLGSVGFGGGINSAILRYVGAPAVDPTTSQLPFSNPLLETNLHPLVNPAAPGGPSPGDVDVAINLDILFDVSILKFTVNGATFDEPPVPVLLQILSGAHTASSLLPSGSVYTLPPNKVIELTIPGGGIGAPHPIHLHGHTFKVVRSAGSSTYNFVNPVERDVVNVGQAGDNVTIRFVTDNAGPWILHCHIDWHLVLGLSVVFAEDVPTIDSSVQPPAWHDLCPIYDALPPGTR

SEQ ID NO: 160 - protein, 447 aa, Thermoplasma volcanium GSS1
MMRYVIASSRCPFSHDVVMGRELVKENVGGVATALKRAISKHGGTWICWGDGKADNRYVNEDVGTYKIKRIILTPQEKRGYYDMYSNRTLWPLFHYFRERVQYTDNGYETYRKVNEKFAEEILNNTSQEDIVWVHDYQLSLVPGILRQKGLKNRIIFTWHIPWVSREMFETLTESDEIKESVGSADFITFHTDLYRKNFESLFENRKHGKSIAVPLGIDYRYFEKAKSSQIKSYALKDKIMLFSIDRLDYTKGLTNRVLSIERLIRNHPETSGKFVYVMIVTPSRTSVSDYVSMKRELEMNIGRVNGEFGTISWMPILYMYRKISDHSLVSYYKSADIALITPLIDGLNLVSKEFIASTEKGILVLSKFAGASNCLRGALIVNPNSPDEVADAIYKAMNMERKEADERLLKMKAIVKARDTDWWIKRIYRLAIAKEHDRRVTNNRIE

SEQ ID NO: 161 - protein, 126 aa, Oryza sativa
  misc_feature (82)..(82): Xaa can be any naturally occurring amino acid
ITGRILESLRMDPRKAVDASYDLYEEERDDLLKRLYRRAKAMEGAFNSIVRITCIMTECAMYLFPRIYLPQKACEADWAVNXAPDACYGVHLCDTTGIVVTTGSVFGQVARTWHVRCTILPQEEKI

SEQ ID NO: 162 - protein, 793 aa, Vitis vinifera
MMSRSYTNLLDLATGNFPAIGRERKRLPRVMTVPGNVVSSDNPSSVAQDRLIIVANQLPVKANRRADDRGWVFSWNEDSLLLQLKEGLPEDMEVLYVGSLRVDVDLEEQEEVSQILLETFKCVPTFLPHDVLEKFYHGFCKKLLWPLFHYMLPFSADHGGRFDRSMWEAYVLANKLFSQKVIELRMGFFLHSPFPSSEIYRTLPVREEILKALLNSDLIGFHTFDYARHFLSCCSRMLGLEYQSKRGYIGLEYYGRTVGIKIMPVGIHMGRIASVMKLADKQKKVGELKQQFEGKTVLLGVDDMDIFKGINLKLLAMEQLLQQHSKWQGKAVLVQIANPARGKGADLEEIQAEIRESCRRINEEFGEPGYEPIVFVDRPVSISERIAYYSIAACVVVTAVRDGMNLTPYEYIVCRQGTDDSESMLSEFIGCSPSLSGAIRVNPWNVEATAEAMNEAISMSQSEQLLRHEKHFRYVSTHDVAYWSRSFLQDMERTCSEHFRRRCWGIGLSFGKLSMEAIVSAYCRAKSRAILLDYDGTVMPQNSINKAPSQEVISILNTLCWDKKNTVFIVSGRGRDNLSQWFSPCRKLGLAAEHGYFLRWSQDKEWETCGQSSDFGWKQIAEPVMKLYTETTDGSSIESKESALVWQYGDADPGFGSSQAKEMLDHLESVLANEPVAVKSGHFIVEVKPQGVSKGLAAEKIFTTMTENGKQADFLLCIGDDRSDEDMFEIIGSAMSTNILSANTSLFACTVGQKPSKAKYYLDDASEVICMLESLAEASDSGPSSEEETQVSP

SEQ ID NO: 163 - protein, 404 aa, Frankia sp. EAN1pec
MEFAQSDKLADVCYDVRGPILDEATRLEAAGQRILKLNIGNPAPFGFSAPPSVLAAVVENLAAAQGYSDSKGLLPAREAVVRYAAGKGMTSVTPDDVYLGNGVSELIMMSLQALLNNGDEVLLPAPDYPLWTAVVSLTGGRPVHYLCDESAGWNPDLDDIIRKITPRTRAIVIINPNNPTGAVYDRPVLEELIEVARRHHLMLFSDEIYDRILYDGAEHHSPAALAPDLFCVTFNGLSKAYRLAGFRSGWMTLSGPRQHASSYIEGLNILANMRLCANVPGQFALQAALAEGSGAGDLVLPGGRLLEQRDTVVKLLNDIPGVSCVPPRGALYAFPRIDPEVYPIDDDESFVLDLLQAERILLVQGTGFNWPRPDHVRLVTLPCVDDLTDAVGRIDRFLTTYART

SEQ ID NO: 164 - protein, 584 aa, Monilinia fructigena
MKSFTVFTALTAFFAQASASAIPATSSPIFPRQNTTSNITPTCAHSSTSRSCWGAYSIDTNWYDVTPTGVTREYWLSVENTTITPDGYTRSAMTFNGTVPGPAIIADWGDNLIIHVTNNLEYNGTSIHWHGIRQRRSLEYDGVPGVTQCPIAPGDTLTYKFQVTQYGTTWYHSHFSLQYADGLFGPLIINGPATADYDEDLGPIFLQDWAHQSAFEIWDTARLGAPPALPNTLINGTNTFDCSSSEDANCVGGGKKFELTFVKGKKYRLRLLNVGIDSHFEFAIDGHNLTVIATDLVPITPYTTDTLLIGIGQRYDVIVEANATAGDYWIRGNWGTSCSTNLNAANATGILRYDSSSTADPTSVGTTARGTCGDEPIASLVPHLALDVGSYSLVDEQLSFSAANYFTWTINSSSLVLDWASPTTLKIFKNESIFPTDYNVVALDKSSANDDWVVYVIEDLTGFGIWHPIHLHGHDFYIVGQEATVFNPATSPSSFNLVNPPRRDVAALPGNGYLAIAFKLDNPGSWLLHCHIAWHASEGLAMQFVESQSSIAVRMKDTAIFEDTCSNWNAYVPGELFAEDDSGI

SEQ ID NO: 165 - protein, 755 aa, Pseudomonas anguilliseptica
MLLATDLDGTFLGGDPKDRLSLYQTIAAHPEIRLAYVTGRSLESVLPLLADPTLPQPDFIISDVGASLVHGDSLQPIQPLQSAVDALWPGDSQVASAIERFALERQDVPQVRRCSYFCNPEQAANPELLTIAESLGCDLLYSAERYLDFLPKGVNKGSSLQALIDWLELDNDQVLTAGDTLNDLSMLSGQFKGVCVGASEPGLLQATRQYSLVFHAERAGCGGILEAFVHFGFLGKQGIAAEGKQVAEPGKADLMMVYHRLPYEEFRGADGKLQRRRPTSPNGIIPTLLSFFGDGRAGSWVAWAEHDENSGETFDSHTTVDAERYPKLTAARVALSKEEVDIFYKRFSKEAFWPTLHTFWERGQFREDDWQVFLKVNRAFAERTALEAAEGATVWLHDYNLWMVPGYLRELRPDLRIAFFHHTYFPSADVFNVLPWRRQIIGSLLQCDYIGFHIPRQVENFVDAARGVMPLQTVSRQNCAPRFITYGCAVGLERMTTAVDTGNRVVKLGAHPVGLDIERVRSALAAPKIREMMERLRSELAGVKLILSVERLDYTKGILEKLNAYERLLEENPELLGKVTLVTVCVPAAKEMTIYDELQGQIEQAVGRINGRFARIGWTPLQFFFRSLPFEEVSAWYAMADVMWITPLRDGLNLVAKEFVAAQGLLDGRGVLVLSEFAGAAAELKGALLTNPHDPVDMTQTCYVALNMPKAEAQARLRELFDIVNYNDIRRWGDEFLAAVSDPQEQLDRALGLVG

SEQ ID NO: 166 - protein, 994 aa, Coprinopsis cinerea okayama7#130
MSSFRNHRVIIASLFLPTTVVVGESAPPTPERNFEDAPPISIPAIAARLASEKNKPLKSALAGKSTPHSSHTRTPSASGPLKSIVEDLKDKSRLTSPAVRSPATETANPFTKLTRFAEDTPTPGRATPKLDVLAPTSPPAIGRKGFRADGPSSRLHRKSRSRSRRPTVASPVSPVRELDPDSDSWHFEPSTVCNGGLRNAIDSVGERLRKKVWVGTLGTPTDGFGEEVRKEIDERLLSQRESVPVWIPDDEFQSCYDEFCHQVLWPCLHYAVPDAPKTKMFYESATYKQYKAVNERFADVIASIYQEGDIIFVNDYHLMLLPLMLRKRLPNTASIGFFMHVAFPSSEIFRCLSVRKDLLLGVLGADFVGFQTANYARHFRQTVSRILAFEALPKGIQLPEDKGDEQLTEGSVNGKNGRRVRDGLADQGRFVDVASVPMGIDVVQLKERMEDPEVEEWVQVLKQRYAGMKLLGVRHKIAAFEAFLDKYPEWQGKVVLIQVALQTTESNELAGGVADFVSRINSRFSTLTYQPVVFLHTQDLTFSQYLALLTVGDAFIVTSLREGMALRTHEWVECQSKKHGALILSEFTGTYSYSGFRSCIAINPWDTRGTAKAIEQALTMSPEEARSRWEDLHNHVITQTAQNFVTAFLNRTLRSHVAHLASLSQSGTDPSAVPVLDLPRLLPRYKHSMKRLILIDFEGTLWRRDLSHAGMAKTLRKEDEWSEEDEDWPKESVEVLKALSEDRRNEVWVLSGLARTGVLGKVAKVVPKVGIVTSRNSEGQWISMVSHFNLTWKSACLEILNYFTERTPGSFVEEREASVVWRFWSTDTVDETNPDRQWARRQAAEAQNHIFDSLGERFGLRIIPGKNSFLVLPNNISRSTAISAITHPGGPARSPYIGRATWMTPDTDEFALHKSAGGGYVGYGGSGGMGGDGTVEETDFLLAISSDERLLRRLNEDDGAETVSTSGKGTDARWRVDFEELGGMLKVLAGVTSP

SEQ ID NO: 167 - protein, 83 aa, Alteromonadales bacterium TW-7
DYAEYFLDAMGMINDIVTERGAIVVGHWPTEGYDFEASKGMADDNHFVGLGIDEDRQPELTEQRVKAWSAQVFDEMCLSELTD

SEQ ID NO: 168 - protein, 519 aa, Trametes versicolor
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTPSVIPLIETNLHPLARMPVPGSPTPGGVDKALNLAFNFNGTNFFIDNASFTPPTVPVLLQILSGAQTAQELLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLEAGFAIVFAEDVADVKAANPVPKAWSDLCPIYDGLSEANQ

SEQ ID NO: 169 - protein, 412 aa, Burkholderia vietnamiensis G4
MKPIQKSNKLLNVCYDIRGPVLEHAKRLEEEGHRIIKLNIGNLAPFGFDAPDEIIQDMIRNLPASSGYSDSKGVFSARKAVMHYTQQKGVVGVGLDDIYIGNGASELIVMATQALLNDGDEVLLPAPDYPLWTAAVSLSGGTPVHYVCDEQNAWMPDPDDIRRKITPNTKALVVINPNNPTGALYSDELLLELLEIARQHGLIVFADEVYDKIVYDGLEHTALGSLSEDVITVTFNSLSKSYRSCGYRAGWMSVSGLGGDNRRRANDYLEGLGILSSMRLCANVPGQFAIQTALGGYQSINELIVPSGRLYKQRELAYDMLTSIPGVTCVKPQAALYMFPRLDPKLYPIQNDQQFILDLLLEERVLLVQGTGFNWAQPDHFRVVFLPNLDDLADSISRIARFLDGYRKRHSV

SEQ ID NO: 170 - protein, 425 aa, Xylella fastidiosa 9a5c
MMSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 171 - protein, 173 aa, Prochlorococcus marinus str. MIT 9211
MTVGIYFATTTGKTEDIAERLHGLLDGAESPRDMSDVDDLNEFTNHEGIICGIPTWNTGADSERSGTAWDALLEEIGSLNLSGKKVAIFGLGDSSTYTENYCDAMEELHRFFKKAGATMVGYVSTKEYTFDESKSAIGDVFCGLPLDEDSESDMTDARISQWSEQLKQEMSGI

SEQ ID NO: 172 - protein, 482 aa, Pelargonium x hortorum
MENKSKQLLSKIATNDGHGENSPYFDGWKAYDRDPFHPSQNPNGVIQMGLAENQLSSDLIEDWVRSNPEASICTLEGVGKFKDVANFQDYHGLLEFRHAVAKFMSRGRGGKVTFDPDRVVMSGGATGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFVAPEFVSVSEILQEMDDTTCNPDLIHIVYSLSKDLGMPGFRVGIVYSFNDDVVSCARKMSSFGLVSTQTQHLLAAMLSDDVFVERFLAERRRLGRRHGVFTKGLEELGIGCLKSNAGLYFWMDLRKLLEEETFEAEMVLWKVIINEVKLNVSPGSSFHCVEPGWFRVCFANMDDETVHVALKRIRAFVRKKEVGPVKRKRFMDNLNLRLSFSSLRYDESVMLSPHIMVSTHSPLVRART

SEQ ID NO: 173 - protein, 545 aa, Coprinopsis cinerea
MRDSALPVLFLLFGLFPGIQGKVLSSASTLVVHNQFVAPDGFNRSAVLVNGVHPSPLIKANKGETYYLNVVNKLHDSTMLRSTSVHWHGLLQHGTAWADGSQSVSQCPISPGHSFEYRFPGGDQAGTFWYHSHFGTQYCDGLRGPFVIYDENDPYKHLYDVDDENTIITVADWYHTPAPSLPIPAFADSTLINGKGRYPGGPKVDLAIVNVVKGKRYRFRLLSLACEPNYQFSIDGHRMTIIEADGYLTEPVVVDRIQIFTGQRYSFILEANRPVANYWIRALPNYGNNGLTLGFEGGINSAILRYAGAPKSEPIYSNWPLDRGVQLLESMLHPIYSPPAPGPPVPGAADVNIYLDMGFQPESLTYTVNGSVFEPPSVPVLLQIMSGAKNAAELLPKGTLYPLKRNQVVELTVPGGLIGGPHPFHLHGHSFSVVKSAGSQTYNFDNPVRRDVTNAGEEGEEVVIRFETDNSGPWLFHCHVEFHLQMGLAIVFAEDIEGMVDRNPVPGAWKELCPIYDALPEDEKTVTILEPTNNTEVSSDAPTTN

SEQ ID NO: 174 - protein, 898 aa, Oryza sativa Japonica Group
MSRSYTNLLDLAAGNFEALGPAGGGRRRSFGAKRMTRVMTVPGTLSELDDEDDEPAATSSVASDVPSSAACERLIVVANQLPVVARRRPGAAAGGWAFSWDDDSLLLRLRDGVPDEMEVLFIGTLRADVPPASRTKVSQSLIDGFGWAPVFLPAGLYDRFYQHFCKGYLWPLFHYMLPFASALPAAASGDGRFDRGAWEAYVLANKYFFEKVVEVINPEDDYVWVHDYHLMALPTFLRRRFNRLRIGFFLHSPFPSSEIYRSLPVREEILRTLLNCDLIGFHTFDYARHFLSCCSRMLGIEYQSKRGYIGLDYFGRTVGIKIMPVGIHMGQLQSVLRLSEKEKKVAELRQQFEGKSVLLGVDDMDIFKGINLKLLAFENMLRTHPKWKGRAVLVQIANPARGKGKDLEAVQAEIRESCDRINKEFGQSGYSPVIFIDQSVPSAVRLAYYTVAECVVVTAVRDGMNLTPYEYIVCREGIPGSECAPEVSGPKKSMLVVSEFIGCSPSLSGAIRVNPWNIEATAEALNEAISMSEREKQLRHEKHYRYVSTHDVAYWSKSFVQDLERACKDHFRKPCWGIGLGFGFRVVALDPHFTKLNFDSIIMSYERSKSRAIFLDYDGTLVPQASLNKNPSEELLRIINTLCADRNNTVFIVSGRSKDDLSKKLISCPKLGIAAEHGYFLRWTRDEEWQTTAQTSDFGWMQMAKPVMDLYTESTDGSTIETKETALVWHHQDADQGFGSSQAKEMLDHLESVLANEPVSVKSGQFIVEVKPQGVTKGLIAEKVLTSMKEKGQLADFVLCIGDDRSDEDMFENIADVMKRSIVAPKTPLFACTVGQKPSKARFYLDDTFEVVTMLSSLADASEPDLMADLEDDLATSVSSIEISDRVVSFSNLRTEGS

SEQ ID NO: 175 - protein, 473 aa, Burkholderia sp. 383
MSRLIVVSNRVAAGEDTRPSAGGLAVGVMDALKETGGVWFGWNGEIVDAPDTEPAIQQDGNVTYATVGLNRRDYDQYYRGFSNATLWPVFHYRGDLARFDRQEYAGYLRVNAMLAKQLAALLRPDDLIWVHDYHLLPFAHYLRELGVKNPIGFFLHIPFPSPDMLRLVPPHEELVKFMCAYDVAGFQTETDKQAFTDYIERRGIGAASDDGMLHAHGRVVKVAAYPIGVHPDAIAQAAVQYSARKPVKMLREALDGRKLVMSVDRLDYSKGLVERFQSFERMLANAPGWQGRVSLLQIAPPTRSDVKTYQDIRETLEGEAGRINGRFSQLDWTPIQYLNRKYERNLLMAFFRMSQVGYVTPLRDGMNLVAKEYVASQDPADPGVLVLSEFAGAAAELTGALLVNPYDLSQMAEALERALSMPLAERQARHEENLARLRVNDLSVWRDTFVADLRSVAAAASVTRRAGRRVAHA

SEQ ID NO: 176 - protein, 533 aa, Coprinopsis cinerea
MSFAWKALATLAVAIASRSAFAQSIIGNQDTMTISNINAGPDGFTRPVIAVNGEFPSPLVRANKGDDFRINVVNNLDDDTMLRQTSVHWHGVFQHQSAWADGPDGVTQCPIPQSGQEFEYAFNAGQEAGTFWYHSHYGTQYCDGLRGPLVIYDPEDPHQDLYDVDDENTIITLADWYHLQAPSIQGPAVSQATLINGKGRRPGSTEGDIAVVNVEKDSRYRFRIVSLSCDPDYTFSIDNHTMTIIEADGQNTKPLEVESIRVFAGQRYSVVVNADQAIGNYWIRAEPNIGDTGLVGTSGGGVNSAILRYATADEVEPDTPRLTNRPALQESNLRALTSGVPGGDGPADITFTFNLGLNFATGTFSMNPGESWVHPDTPVMVQIMNGVPAEDLVPAESLHTITRGQVVEVVIPPFGIAGPHPFHLHGHAFSVIKSAGGSPNFVDPVRRDVVAVGTEAGQGDTIIRFVADNPGPWFFHCHIEFHLVTGLAAVFMEAPDEIASSNPPPPSWDALCPAFSALPPSATSIRIVPTPTP

SEQ ID NO: 177 - protein, 140 aa, Brassica napus
  misc_feature (17)..(17): Xaa can be any naturally occurring amino acid
  misc_feature (88)..(88): Xaa can be any naturally occurring amino acid
STHASDFDQPGDDSYDXYIAEKEGILSSLAKRAKTLEEALNKLEGVTCNRAEGAMYLFPCINLPQKAIAAAEAAKTAPDAFYCKRLLXATGIVVVPGSGFRQVPGTWHFRCTILPQEDKIPAIVNRLTEFHKSFMDEFRN

SEQ ID NO: 178 - protein, 511 aa, Parvularcula bermudensis HTCC2503
MSTKSKSDLVILYHRQPYEEVVENGQTTFKENKSPNGIVPTLKGFCASADKGTWVAWKQVAPKQQSKFQRRVTIEDDYGDYDVVRLPLSADQVKSFYHVTSKEAFWPVLHSFPWLFSSENSNWDTFREVNRLFAEAACEEVSDDGLIWIHDYNLWLAPYYIRKIKPDTKIAFFHHTPFPSADIFNVLPWREEIVDSLLCTDLLGFHIPRYAENFCGVARALRGVDLADRLDVFPPLVSSGMALSEPTVTPYIEHKGRRIVIDSRPIGTNPPLIQDYLSRFDAGERVAEIRSEIGDLHLIISVGRVDYTKGAKETLEAFDRLLSRRPELTGKVKLMMVCAAAAQGMTIYRTAQREIERLVGSINGKYGTLGWTPIMLTMRPIPFEELVSYFRVADTCWITPVRDGLNLVAKEYIAAKEGSSGALVLSEFAGVAVELPQAILTNPYSANDMDAAIDCAIDMSVEERKERMKALYETVTTWDIRFWAQHVTGLFDELRGKKSTKATTGAAEDAA

SEQ ID NO: 179 - protein, 232 aa, Oryza sativa Indica Group
MAMAAAPRPKSPPAPPDPCGRHRLQLAVDALHREIGFLEGEINSIEGIHAASRCCREVDEFIGRTPDPFITISSEKRSHDHSHHFLKKFRCLCRASACCLSYLSWICCCSSAAGGCSSSSSSSFNLKRPSCCCNCNCNCCSSSSSSCGAALTKSPCRCRRRSCCCRRCCCGGVGVRACASCSCSPPCACCAPPCAGCSCRCTCPCPCPGGCSCACPACRCCCGVPRCCPPCL

SEQ ID NO: 180 - protein, 486 aa, Triticum aestivum
MSPASARALTVDSLNPKVLALADHLGGAVARRAERMQKELETNPGLYPFNEIIYCNLSNPHYLGQQPIKFFREVLALCDYPHLLNCSVTSSIFSSDAITRAREILDLIPGRAMGGYSHCQGTEGLRNAIAAGIATRDAFPCNAEDIFLTDGAAAPVHMVMHLLIRDEKDGILCPIPSHFLYTSSMALCGATLVPYYLDESGGWAVSISNLKKQLDGARSEGITVRGLVVVNPGNPTGQVLVKENQCEIVEFCRNENLVLLADEVYQENVYTDEKKFISFKKIARSMGFGEEDISLISFHSVSNGYYGECGRRGGYMEVTGFNSEVRKQVYKVASLSSCSNLAGQVLVSLVMNPPKVGDESYTSYWEERDRIMLSLSRCAEAMVQAFNSLEGLTCSKAEGAMFVFPSVRLPKRAIAAAEAMNTKPDVFYALRLLENTGIVLLPGSVFGQVPGTWHFRCTILQQEEKIQLIINRFKAFHKAFMEEFRD

SEQ ID NO: 181 - protein, 1054 aa, Saccharomyces cerevisiae
MTIIVASLFLPYTPQFEADVTNSDTAKLVESSMIKVDCNNQELSNNKQERSSSVTSASSHYIGLPQEAQINGEPLQRANVGSPATGVNYHNEMEMLSSEQFLEELTANATHAANSGIPPANNPVSSGSTAQRPSVEEFFSAPSARVCSPSQEASASSISASRSSAHHNDLSSSLMKNPNLSFDSHPPRVRSSSKSAVITPVSKSVPDVDPAVVDVAKVREEFQQQASLPSMKRVSGSTAGDSSIASSSSNLRYSQQFQDNFIEDTDSEDDIDSDLETDATKKYNVPKFGGYSNNAKLRASLMRNSYELFKHLPWTIVDSDKGNGSLKNAVNIAVAEKTVKEPVSWVGTMGIPTDELPHEVCHKISKKLEQDFSSFPVVTDDITFKGAYKNYAKQILWPTLHYQIPDNPNSKAFEDHSWDYYQKVNQKFSDRIVSVYKPGDTIWIHDYHLMLVPQMVREKLPKAKIGFFLHVSFPSSEVFRCLANRERILEGIIGANFVGFQTKEYKRHFLQTCNRLLAADVSNDEVKYHCNIVSVMYAPIGIDYYHLTSQLRNGSVLEWRQLIKERWRNKKLIVCRDQFDRIRGLQKKMLAYERFLIENPEYIEKVVLIQICIGKSSDPEYERQIMVVVDRINSLSSNISISQPVVFLHQDLDFAQYLALNCEADVFLVDALREGMNLTCHEFIVSSFEKNAPLLLSEFTGSSSVLKEGAILINPWDINHVAQSIKRSLEMSPEEKRRRWKKLFKSVIEHDSDNWITKCFEYINNAWESNQETSTVFNLAPEKFCADYKASKKHLFIFKISEPPTSRMLSLLSELSSNNIVYVLSSFTKNTFESLYNGVLNIGLIAENGAYVRVNGSWYNIVEELDWMKEVAKIFDEKVERLPGSYYKIADSMIRFHTENADDQDRVPTVIGEAITHINTLFDDRDIHAYVHKDIVFVQQTGLALAAAEFLMKFYNSGVSPTDNSRISLSRTSSSMSVGNNKKHFQNQVDFVCVSGSTSPIIEPLFKLVKQEVEKNNLKFGYTILYGSSRSTYAKEHINGVNELFTILHDLTAA

SEQ ID NO: 182 - protein, 549 aa, Coprinopsis cinerea
MTSRLLGYLQLAIVLYNSVARGQMILSPSDTMVISNANVSPDGVTRSAVVVNGVHPGPVLIGEKDDVFAINVVNELTDPTMLRSTSVHWHGLFQRGTNWADGAEGVNQCPISPERSFLYRFSPAGHAGTFWYHSHFGTQYCDGLRGPMVVYDPDDPYKNEYDVDDVNTIITLADWYHTPAPSIRGPFFPDSTLINGIGRTPGGPKVDLAVVNVEAGKKYRFRIVSLACDVNFQFSIDKHKLTIIEADGQLTDPLEVDRIQIFTGQRYSVILNANQTPDVYRIRAIPNAGVHGLTDTTAGGVNSAILRYANAEATELPQEDELPSNLVDLQEWMLHAYAGGDPAAPGRPEAGGADVRIPLRFTFSGGRFFVNGTAYSSPSVPTLLQIMSGANPGELLPENSIYYLPRNQVIEVEIPSAGISASGPHPFHIHGHAFSVIRSAGNTSYNYVNPVKRDVVNIGGDSDLVTIRFVTDNPGPWFFHCHIEPHLVGGLAIVFAEAMKDTMSANPDVPDEWKDLCDIYDKLEPSLTSLSIIRRAEPTDLSAKFRGLY

SEQ ID NO: 183 - protein, 410 aa, Chromobacterium violaceum ATCC 12472
MQPVHKSQKLANVCYDIRGPVLEHAKRMEDEGHRIIKLNIGNPAPFGFFAPDEIIEDVIVNLPAASGYSDSKGLFAARKAIMHYAQQKHLPNVAMDDIIVGNGVSELIVMAMQALLDNGDEVLVPAPDYPLWTAAVSLAGGKAVHYLCDEEQGWFPSIDDIRAKITPTTRAIVIINPNNPTGAVYPPALLQQIVDVARQHQLIIYADEIYDKVLYDAVRHTSIASLAPDLFVVTLNGLSKNYRACGYRAGWMILSGEKKHAKDYIEGLNMLASMRLCANVPSQYAIQTALGGYQSIDDLVAPGGRLARQRDLAHKLLTEIPGVSCVKPQGALYLFPRLDPKVYPIADDQQFILELLQQEKVLLVQGSGFNWIAPDHFRVVFLPNSDDLIEAIGRIARFLESYRKRHGAAE

SEQ ID NO: 184 - protein, 567 aa, Coprinopsis cinerea
MSPAVIAAGSTSFPFVGSVATLNIGNANLSPDGFERPSSVVNGVFPAPLIKANKGDHFSLNVVNDMTDDTQFRATSIHWHGIYQKHTNWADGVAGVNQCPIGPGDSFLYQFDVPNQAGTFWYHSHFRTQYCDGLRGPLVIYDPEDPYRDLYDVDDENTVITIGDWYHLQSPSITGVASNDATVINGKGRYVGGPLVDLAIINVVPGKRYRLRIMAISCDPNYIFSIDGHQLTVIEADAQSTQPLVVDSIQIFAGQRYSAILTADQPIGNYWIRALPNSGNNNLFTGFIDGTNSAILRYAGAPIADPTTSAPDAPVLLDETLLVPLDTTPVPGQPFPGGADVNLLLNLDFNVDAWRFYVNNETFNPPTVPVLLQVMSGAVAAQDLLPAGSVYTLPPNASVEISIPGGVISSPHPFHLHGHSFSVVKSAGIDTPYNYVNPVKRDVVSTGDVGSNTTIRFFTDNSGPWILHCHIDWHLDLGLAIVLAEDPVGTPALNPTPQDWDDLCPAYDALDPSMTEIAVVATPSPLDPQVVSVPESYLATSTEAEDVTVTVTVTVTEGDDAAATDSS

SEQ ID NO: 185 - protein, 481 aa, Vitis vinifera
MSHKGLDYETLNENVKKVQYAVRGELYLRASELQKEGKKIIFTNVGNPHALGQKPLTFPRQVVALCQAPFLLDDPNVGLVFPADAIARAKHYLSLTSGGLGAYSDSRGLPGIRKEVAEFIGRRDGYPSDPELIFLTDGASKGVMQILNTIIRGERDGILVPVPQYPLYSAAISLFGGSLVPYYLEETANWGLDVNNLHSSVAAARSKGITVRAMVIINPGNPTGQCLSEANLKEILHFCYQENLVLLGDEVYQQNIYQDERPFISARKVLMDMGPPISKELQLVSFHTVSKGYWGECGQRGGYFEMTNIPPQTVDEIYKVASISLSPNVPGQIFLGVMVNPPTPGDISYLQFMRESKGILESLKRRAQIMTDGFNSCRNVVCNFTEGAMYSFPQIRLPPKAIEAAKKAGKVADVFYCLKLLEATGISTVPGSGFGQKEGVFHLRTTILPAEEDMPAIMESFKKFNDEFMEQYEDHRGYSRM

SEQ ID NO: 186 - protein, 912 aa, Oryza sativa Japonica Group
MSRSYTNLLDLAEGNFAALGPGGGGGGRRRSGSFGLKRMSRVMTVPGTLSELDGEDDSEHAATNSVASDVPSSVAGDRVIVVSNQLPVVARRRPDGRGWSFSWDDDSLLLQLRDGIPDEMEVFFVGSLRAEIPVADQEEVSQALLDRFRCAPVFLPDPLNERFYHRFCKRHLWPLFHYMLPFSSSASPSPSSSSSSSSSPSSSSGSGHFDRGAWEAYVLANKFFFEKVVEVINPEDDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGVHMGQLKTVLSLPDREWRVSELQQQFEGKTVLLGVDDMDIFKGINLKLLAFENMLRTHPKWQGRAVLVQIANPARGKGKDLEAIQAEIHESCKRINGEFGQSGYSPVVFIDRDVSSVEKIAYYTIAECVVVTAVRDGMNLTPYEYIVCRQGSDSTSEVNGPKKSMLVVSEFIGCSPSLSGAIRVNPWNIEATAEALNEAISMSEQEKHLRHEKHYRYVSTHDVAYWSKSFIQDLERACKDHFRRTCWGIGLGFGFRVVALDPHFTKLNMDSIVMAYERSESRAIFLDYDGTLVPQTSISRTPSAEVLRIINTLCSDRRNKVFLVSGRRRDKLGEWFSSCPDLGIAAEHGYFLRWTRDEEWQTCTQTSDFGWMEMAKPVMNLYTEATDGSYIDPKESALVWHHQDADPGFGSSQAKELLDHLESVLANEPVSVKSGQFIVEVKPQGVSKGVVAEKILVSMKERGKQADFVLCIGDDRSDEDMFENIADTIKKGMVATNTSLFACTVGQKPSKAKFYLDDTFEVVTMLSALADATEPEPETDLTDEFDELAVSVSSVDIDDEQTPSDKLIGG

SEQ ID NO: 187 - protein, 513 aa, Oryza sativa Indica Group
MASAMVRAMSTAAAGAAPVSLDTINPKVLKCEYAVRGEIVTHAQFYDFLRNLDYDLHFILQNLQQELQKNPDSLPFDEILYCNIGNPQSLGQQPVTFFREVLSLCDHPALLDKSETHALYSSDAIERAWQILDKIPGRATGAYSHSQGIKGLRDEIAAGIAARDGFHASGDNIFLTDGASPAVHMMMQLLIRSENDGILCPIPQYPLYSASIALHGGSLVPYFLDEETGWGLEVDELKKQLEEAQSKGITVRALVVINPGNPTGQVLAEENQKKIVEFCKNEGLVLLADEVYQENIYVEDKKFHSFKKIARSMGYTDDDLPLVSFQSVSKGYYGECGKRGGYMEVTGFSADVREQIYKVASVNLCSNVSGQILASLIMNPPKAGDESYESFMVEKDGILSSLARRAKALEEAFNSLEGITCNKAEGAMYLFPRIYLPQKAIGAAQAAGTAPDAYYARRLLEATGIVVVPGSGFGQVPGTWHFRCTILPQEDKIPAIISKFKEFHEKFMDEFRD

SEQ ID NO: 188 - protein, 410 aa, Acidovorax sp. JS42
MKPIRKSAKLNNVLYDVRGPIVDAAKQMEDEGQKIIKLNIGNLAPFGFDAPEEIQQDMIRNLPNSAGYSDSKGIFAARKAVMHYSQQQGVAGVTLDDIYLGNGASDLITMATNALLDDGDELLVPAPDYPLWTAAASLSGGRPVHYLCDEDNGWMPSLTDIRAKITPRTRGIVVINPNNPTGALYSDELLKGIVQIAREHNLVLFADEVYDKVLYDGVKHTAMASLSTDVVTLTFNSLSKAYRSCGYRAGWMVISGDKTAARDYIEGINMLANIKLGSNVPGQWAIQTALGGYQSINDLVKPGGRLCRQRDLAYELITAIPGVTCVKPQAALYMFPRLDPEMYPIADDRQFFMEVLRATRVMLVQGSGFNYPDNQHFRIVFLPHEDDLREAIGRLAGFLAAYRQRHAKAA

SEQ ID NO: 189 - protein, 878 aa, Debaryomyces hansenii CBS767
MTNALNEIENMSAFPSDGKTVSPKDYANNDKLKLSGRIINVMTLLPTQIVKKTNKSGNDNWDVEPVRGNSALYSSQFFLAQQTDWESHLVGWTGELINKSSNSKSIINENITDDPLYLNKEDKTSLEGKIRDANKSAHIHPVWLLRRDQERWRNYAENVLWPVFHYIQGEPSDGKDEASSWHDYVKFNEAYCQKIISIYKPGDVIWIHDYYLLLLPQLLRMEIPNAIIGLFMHAPFPSSEYFRCLSKRSHLLDGMLGADKIAFQSEAFQRHFSSCCTRLLGCEISKDKLMAYGSAISLETLPIGIDTKKIEYDAFSSDSGIEQKVRALGEIYADKKIIVGRDRLDTVRGVVQKLQAFEMFLQMYPEWRDKVVLIQVSSPGYSHSAKVEQKVTELVHHINSEYGDLNSTPILHYQKRINKDEYLALLRVADLALITSVRDGMNTTSLEFVLCQKENYSPLILSEFTGTASVLSEAILVNPWDSVGIAKTMNDCFYMSKDKKRALEERLYKQVTSNTIQNWTSNFITHLIDHVNNTHQTHYTPALNRPLLLNNYENSHRRLFLFDYDGTLTPIVKDPAAAIPSSRLNAVLDILSSDPKNQVWVISGRDQAFLDKWLGSKNIGLSAEHGCFLKDIGSTEWSNLSASFDMSWQTKVKEVFKEYTEKTPGSNTEQKKVALTWHYRRSDPELGKYQAEKCLKFLKETVATEYDVEVMPGKANIEVRPNFVNKGEIVKRLVLNPHGAKQIPHVVTNYNKDVPVDELPDFILCLGDDFTDEDMFKSLKDIEAEWSLKDHPTNQYGSHGVYPVAVGPASKQTIATSHLTEPSEVLETLGLLSGVVSLFESAGSVSLDDRGHLENSTSSNKSKSAIKEATKKEGSKSC

SEQ ID NO: 190 - protein, 477 aa, Carboxydothermus hydrogenoformans Z-2901
MRGNLLVVSNRGPFTIEENNGSLKYRPAVSGLVSAVLPAVKKIGGTWLAWAGRIAEKPAEVQAVIKDEFQFVEILLSREEVEGYYEGYANGVLWPLCHLMPEKVRMYEENYRIYREVNQKFAQKAATLLRTGTLLWIHDYHLALMPHFIRQKNPWQRIAFFWHIPFPPVELFTIQPWAEEILRGLLGADIIGFHIDDYRENFLRAVERVLKLPVNYEWGTVYYNGREVLVKAVPIGIETKNFQKEVPEITEIEQEIAGLKIFLGVERLDYTKGLKEKIQGFARFLEKNPEYRGKVKLLQVAVPTRENIDQYQTYAREVLAEAAKVNERFGDNHWQPIKILKRNYSQEELIYLYRIADALVITSLEDGLNLVAKEYIASRKEPGVLILSKRTGVARQLNAALLVNPYSPEEIALKMKEAIEMPDTLKKKSFSLLKEQVILKNNEWWLENFLGKELRLMDTGFGKYYRKRGEKKVGAID

SEQ ID NO: 191 - protein, 463 aa, Streptomyces avermitilis MA-4680
MASTRGAQILVASNRGPVSYTLDETGTLTSKRGGGGLVSGLSAIGPDAGALWVCSALGEGDREAVRRGVGEPGVRMLDVDAEVHADAYNGIANSVLWFVHHMLYQTPLEPVFDAEFRRQWAAYETYNHAFAAALAEEAAEGAAVLVQDYHLTLVPRMLRELRPDLRIGHFSHTPWAPSEYFRMLPDDIAAQVLGGILGADRAAFLTQRWADAFTDCCHAVLGPGIPSGTRIGVHGLGADADFLRERAHRPDVEERMAALREEVGEGRKTIVRVDRTELSKNIVRGLLAYRELLASRPDWRERVVHVAFAYPSRQDLAVYRDYTAAVQRLADEINAEYGTPGWTPVVLHVKDDFARSLAAYRLADVALVNPIRDGMNLVAKEVPVVSDEGCALVLSREAGAYEELGEDAITVNPYDVVGTAVALHEALSMPAGERAERTKRLAGAATALPPARWFLDQLHALDT

SEQ ID NO: 192 - protein, 476 aa, Acinetobacter sp. ADP1
MSQKKSVIFKNLLPVIKQYQQAGFTHEKIVALLKDQHDLDLVTTETFKSYLYRYAKVTPTPSESLKMTNTIQTPREIKKSSKLEHVCYDIRGPVLRAANEMEEQGHKIIKLNIGNPAPFGFEAPQEIINDVALNLPNAIGYTDSKGIFPARKAICQYYQQKGIRDMHVNDVYVGNGVSELIVMAMQGLLNDGDEMLVPMPDYPLWTAAVNLSGGTAIHYKCDEENSWYPDIVDMESKITPNTRGIVVINPNNPTGSVYPRHVLQQIVALAKKHDLILFADEIYDKIIYDGIEHVALASLAGDQLCISFNGLSKSYRVAGYRSGWMAITGDKSRAKDYIEGLDMLASMRLCANHQAQYAIQTALGGYQSINDLIRPSGRLYEQRNIAWEMLNEIHGVSCVKPEGAMYCFPKLDPNIYQVEDDEQLMLDFLRAEKVLLVQGTGFNWPTHDHFRLVFLPAENELREAITRLSRFLATRR

SEQ ID NO: 193 - protein, 537 aa, Vitis vinifera
MRRFVSGVLSSYQKRSLSHRSLRFFSSTTSLSNSDSPSSSSSAAMPTPVTLETINPKVLECEYAVRGEIVTLAQRLQQELQEKPGSLPFDEILYCNIGNPQSLGQQPITFFREVIALCDHPPILDKSETQGLFSADAIERAWQILDQIPGRATGAYSHNVISILLYFCPHQGIKGLRDTIAAGIEARDGFPSNPNDIFLTDGASPAVHMMMQLLIRTEKDGILCPIPQYPLYSASIVLHGGTLVPYYLDEATGWGLEISELQKQLEDAKSKGITVRALVVINPGNPTGQVLSEDNQRDIVEFCKKEGLVLLADEVYQENVYVPDKKFHSFKKISRSMGYGEEDISVVSFQSVSKGYYGECGKRGGYMEVTGFGADVREQIYKVASVNLCSNITGQILASLVMSPPKVGDESYESYFMEKDGILSSLARRAKTLEDALNSLEGVTCNKAEGAMYLFPRIHLPEKAIKAAEAAKTAPDAFYARRLLNATGIVVVPGSGFGQVPGTWHFRCTILPQEDKIPAVVSRLTEFHKGFMEEFRD

SEQ ID NO: 194 - protein, 516 aa, Coprinopsis cinerea okayama7#130
MQLLAFVLAALPLARAAIGPVGNLVIANANVSPDGFVRSAVLAGATGTSLEHPGPVIVGQKGDTFHINVIDDLTDPTMLRTTSIHWHGFLQEGTAWADGPAGVTQCPIAPGHSFLYKFQAKNQAGTFWYHSHHMSQYCDGLRGVMVVYDPLDPHRHLYDVDNENTIITLADWYHDPAPSAGLVPTPWSTLINGKGRYPGGPVVPLAVIHVSRGKRYRFRLVSLSCDPNYVFSIDGHTMTVIEVDGVNHEPLVVDHIQIFAGQRYSFVLNANRPVNNYWVRANPNLCSVGFGGGINSAILRYVGAPAVDPTTSQLPFSNPLLETNLHPLVNPAAPGGPSPGDVDVAINLDILFDVSILKFTVNGATFDEPPVPVLLQILSGAHTASSLLPSGSVYTLPPNKVIELTIPGGGIGAPHPIHLHGHTFKVVRSAGSSTYNFVNPVERDVVNVGQAGDNVTIRFVTDNAGPWILHCHIDWHLVLGLSVVFAEDVPTIDSSVQPPAWHDLCPIYDALPPGTR

SEQ ID NO: 195 - protein, 821 aa, Arabidopsis thaliana
MDYDDARGERPRLLVVANRLPVSAKRTGENSWSLEMSPGGLVSGLLGITSQFDTKWVGWPGVDVHDEIEKNALTESLAEMKCIPVFLNGVFDQYYNGYCNGILWPILHHMGLPQEDQHDTNQTFETQYDAYKKANRMFLDVIIDNYEEGDIVWCHDYHLMFLPQYLKEYNNKIKVGWFLHSPFPSSEVYKTLPSRSELLRAILAADLLGFHTYDFARHFLSTCTRILGVEGTHEGVVYQGRVTRVAVFPIGIDPDRFIRTCKLPEVTQQMNELQEKFAGKKVILGVDRLDMIKGIPQKYLAFEKFLEENPYWRDKVVLVQIAVPTRNDVPEYRKLKSQVHGLVGRINGRFGSVSSLPIHHLDCSVDFNYLCAIYAIADVMLVTSLRDGMNLVSYEFVACQEAKKGVLVLSEFAGAGQSLGVGALIVNPWDVTEVSSAIKEALNMPAEERETRHRSNFQYVCTHSAEKWGLDFMSELNGIIPESEMQMRKIPLQLPEQDVIQQYSQSNNRLIILGFFGTLAEPMNSGTKEMDLKLNPELKGTLKALCNDPKTTVVVLSRSGKNILNKNFGESNIWLAAENGMFEKQTTGEWVTNMPQNVNLDWVDGVKNVFKYFTDRTPRSYFEASETSLVWNYEYADVEFGRAQARDLLQYLWAGPISNASVDVVRGNHSVEVHAIGETKGAAIGRILGEIVHRKSMTTPIDFVFCSGYFLEKDEDIYTFFESKILSSKSPNGLDLKKENYFSAAIGQARTKARYVIDSAHGVVDLLHKLAVVADTTMTDSFSDSEIYEPRDANANENSKRWINSVRRRKVEIGDTGQIGM

SEQ ID NO: 196 - protein, 167 aa, Fusobacterium nucleatum subsp. nucleatum ATCC 25586
MKTIGIFYATLTKTTVGIVDEIEFFLKKDDFKTFNVKNGVKEIENFENLILVTPTYQVGEAHAAWMNNLKKLEEIDFTGKVVGLVGLGNQFAFGESFCGGIRYLYDIVVKKGGKVVGFTSTDGYHYEETSIIENGKFIGLALDEENQPNLTPKRIGDWITEIKKEFK

SEQ ID NO: 197 - protein, 392 aa, Ganoderma sp. BS-1
WHGFFQKGTNWADGVAFVNQCPISSGNSFLYDFQVPGQAGTYWYHSHLSTQYCDGLRGPFVVYDPEDPLLSMYDVDDDSTVITLTDWYHTAAKLGPAFPLGADATLINGLGRSPATSTAELAVINVTQGKRYRFRLISMSCDPNYTFSVDGHDMTVIEADGIETQPVTVNAIQIFAAQRYSFVLTADQDVDNYWVRANPNFGNVGFTDGINSAILRYDGADPVEPTTSQQTTQNLLNEVDLHPYVAIPTVPGSPTPGGVDLAINFAFNFNGSRFFINGDTFVPPTVPVLLQILSGAQTAQELLPSGSVYELPMNSSIELTFPATASAPGTPHPFHLHGHEFAVIRSAGSTEYNYDNLRVRDVVSTGVAGDNVTIRFQTNNPGPWILHCHIDF

SEQ ID NO: 198 - protein, 352 aa, Gluconobacter oxydans 621H
MGRLIIVSNRTPAPGERTQPAGGLTVGLCDAVQTQETLWFGWSGHQHADAADRPVQSEQVGNVNYVTFDLTQRQYDRFYLNFSNGVLWPLCHYRTNLIRYTREDCDAYYEANEVFADRLVGLLEPDDTVWIHDYHLFPLGKMLRDRGVTGRIGFFLHIPFPPWSVARLLPRLDMLLSGLAACDLIGVQTPEDATNLKGCFEIYGLKAAVEAVPIGIDPVSFRQQAIESASSDEVVKIMDTLEGTRLIMGVDRLDYSKGLPERMKGFEALLKNYPEHRGQVTFLQVTPVSRGGVESYRLLKEELDGLVGTINGAYARRTGCRSATRPGRSGGIFLPGFTGWQMWGLSRRCGMA

SEQ ID NO: 199 - protein, 263 aa, Zea mays
MGRREAERKGGKKPEGDRRGRRKERIQGNDGASCDVVGPSPELGEAEAPPRSRSSLSSKAEVESEPLGRARRRPSAEARAESEPWGRAKRSSSSSGAEPESEPWGRAKRSSSSSGAEPESEPWGRAKRSGAVPLSGRSVERRSDYGHFGSVDWRARVRIKVHMILQLLIRSEKDGILCPIPQYPLYSASIALHGGSLVPYFLDEETGWALEVDELKKQLEEARSKGISVRALVVINPGNPTGQTGPTVPNAMVVQEPFVYIYP

SEQ ID NO: 200 - protein, 519 aa, Trametes sp. I-62
MAKLQFSNFFVTLAVVTGALAAVGEADLTITNAVVAPDGFSRDAVVVNGVFPGPLITGKKGDRFQLNVIDNLTNHTMLKSTSIHWHGFFQAGTNWADGPAFVNQCPISTGHAFLYDFHVPDQAGTFWYHSHLSTQYCDGLRGPIVVYDPLDPHAFRYDVDDESTVITLSDWYHTAATLGLGSRLGADATLINGLGRSSSTPTANVTVINVQHGKRYRFRLVSLSCDPNHTFSIDGHNLTVIEVDGVNSKPLTVDSIQIFAAQRYSFVLNANQTVGNYWIRANPNFGTTGFAGGINSAILRYQGAPIIEPTTVQTTSVIPLVETNLHPLVPTIVPGLPVSGGVDKAINLGFNFNGTNFFINNATFTPPTVPVLLQILSGASTAQDLLPPGSVYPLPAHSSIEITLPATTLAPGAPHPFHLHGHVFAVVRSAGSTAYNYVDPIFRDVVSTGTPAAGDNVTIRFHTDNPGPWFLHCHIDFHLEAGFAIVFAEDVADVKAANPVPKAWSDLCPTYDALAEGDL

SEQ ID NO: 201 - protein, 985 aa, Magnaporthe grisea 70-15
MTVFIASLFLPKTVHFRLPGTPSRSAPPPALDKDRAKGDVPAGGLKSPSHAKQPSLFKDITPPETPIEERPAAEDIFANEDGLAVPQFPAPTDAGKQRGPADRGSPTWGARRDQPMSRANSPPPSSLLNHNKTLALKARELGRMGVKQPLSLTRSDSHDRVFAQADYTIVNADQGNGGLRNAAEAAAREGKLGDHTYVGTLGMPTDALDGTQQKQDIEDRLATEHDCLAVWCSDKDFDGHYSHFCKQILWPVFHYQIPDNPKSKAYEDHSWKYYVNVNQAVADKIVKNWKRGDVIWVHDYHLLLVPGMIRKKLPDAKIGFFLHVAFPSSEVFRCLAVRRELLEGMLGANLVGFQIHEYTRHFLQTCSRILSAEATPDGLQLEDRFVDVINMPIGIDPVALSEHRKEPQVLEWVNKLRKQYEGKHLIVARDKLDHVRGVRQKLLSYELFLNQNPEWRGKTMLIQVALSTSEKSELDATVSDIVTRVNSSWASLTYQPVTYLKQDIGYAQYLALLTIADALMITSQREGMNLTSHEFLACQDGKNSNDKKHGSLILSEFTGTSSLFGGNELSVNPWDYRACADAIKKALEMSAEEKERRWTKLYQAVSHHTGAHWFTEFMLRLDRVHEEQHRRDQTSVPRLSVASLSAQYKRSSKRLFILDYEGTLVSWGPVNQIIPVSPQVQNATSTNPLSAGQQGQPEGRQHIVHPRLGPLTLASPPTIVTHQPPTTIRDVESNVLSPIRPSSPYTTLNKTMRPGDPIQYTDTNPQRTLDVLSDLLLDEQNTIYVMSGRRPEELDRLFRARIPNLGLIAENGCLLRKCGADSWTEMADAGHIKNWKESVRGIMTYFLERTPGAEVEERRCSLVFHYKNAEDYEAAARQASDCASHINDACESQRVHAVALDGCVVVEPVDWTKGTAAEKIFDDLRSGDLSPDFLMVVGDGREDEKVFKWANQLGEEGTVKDVVTVSLGSRNTEARATLTQGVSGK

SEQ ID NO: 202 - protein, 568 aa, Podospora anserina
MRFSFFFGTFLGWATWTVAVPLEHTKRQSCANGPTARNCWGDFSIDDDVTYTWPDTGVTRSYSFDVGLATLAPDGVEKVMMVVNGQYPGPTIEANWGDSVQVEVCNNLSQNGTSIHFHGVRHLNTNHADGAVSQTECPIAPGDCHTYRFKATQHGSSWYHSHYSLQYGDGLLGAIVIHGPTTANWDIDLGPLLITDHYHESVFDLADEPLTSLIGIPPVAVNGLMNGKNAYLTGTGSRAEFTFTPGKKHLLRLVNTGSEMIFRFAVDQHRMTVVAMDFIPIQPFETDTLLIAIGQRYDVIIEADQSPDVAYWARGVPMTSCFAINLMSTDIRAIVRYESDTPVTGDPTSTSWLMLDTCADEDLSNLVPHITHSVGPSALTQNFNAVLLPSQGDNYAVRWRVGGSEPYRPPKNNPVVKQVIDTAAVNLTADFNPIDLTSLAPSSWVYLIVESLAPLPHPLHLHGHDTYVLARGTGPYVELLTSLDLESPPRRDTFNLPQSGYVVLAFQTDNPGSWLLHCHIQWHIHQGFALTLVEGSPSSIQGVYGSGEDAEMRRVCQNWVSSGLETTD

SEQ ID NO: 203 - protein, 520 aa, Trametes sp. I-62
MSRFHSLLTFIVASLASSALASIGPVADMTISNAEVSPDGFARQAVVVNGVTPGPLVKGNMGDRFQLNVIDNLTNHTMLKSTSIHWHGLFQHGTNWADGPAFVNQCPVSAGHSFLYDFQVPGQAGTFWYHSHLSTQYCDGLRGPLVVYDPHDPHKSRYDVDNDDTVITLADWYHVAAKRRSAFPLGADATLINGLGRSPTTPSADLAVINVTQGKRYRFRLVSLSCDPNHTFSIDGHNMTIIEVDSVNSQPLVVDSIQIFAAQRYSFVLNANQAVDNYWVRANPSFGNVGFSGGINSAILRYAGAPAIEPTTNQTTSVIPLNEVNLHPLAPTPVPGKAVAGGVDTPINMAFSFNGTNFFINGASFVPPTVPVLLQILSGAQSAQDLLPSGSVYVLPSNASIEISFPATAAAPGVPHPFHLHGHTFAVVRSAGSTEYNYDNPIFRDVVSTGTPAAGDNVTIRFQTNNPGPWFLHCHIDFHLEAGFAVVMAEDTPDVKAVNPVPQSWSDLCPIYDALDASDQ

SEQ ID NO: 204 - protein, 173 aa, Escherichia coli
MNMGLFYGSSTCYTEMAAEKIRDIIGPELVTLHNLKDDSPKLMEQYDVLILGIPTWDFGEIQEDWEAVWDQLDDLNLEGKIVALYGLGDQLGYGEWFLDALGMLHDKLSTKGVKCVGYWPTEGYEFTSPKPVIADGQLFVGLALDETNQYDLSDERIQSWCEQILNEMAEHYA

SEQ ID NO: 205 - protein, 670 aa, Vitis vinifera
MTCCCLLGAPCDALYKELWHACAGPLVTVPREGERVYYFPQGHMEQLEASTTHQGLDQQMPSFNLPSKILCKVVHVQLRAEPETDEVYAQVTLLPEPDQSEITSPDPPLPEPQRCTVHSFCKTLTASDTSTHGGFSVLRRHADDCLPPLDMSQQPPWQELVAADLHGNEWHFRHIFRGQPRRHLLTTGWSVFVSSKKLVAGDAFIFLRGENGELRVGVRRLMRQLSNMPSSVISSHSMHLGVLATASHAISTGTLFSVFYKPRTSRSEFIVSLNKYLEARNHKLSVGMRFKMRFEGEEVPERRFSGTIVGVGDKNTSSGWADSEWRSLKVQWDEPASIFRPERVSAWELEPLVAAAAPTNLQPAQRNKRARPPVLPSATPDLSVLGMWKSSVESPSGFPYCDPHRGRDLYPSPKFSSITKTNSFSFSGNSSPAAVSSNSMYWSNRMETATESFAPAVNKESGEKRRDTGSGCRLFGFQLLDNSTLEETLPVLTVGEDQPVPSLDVESDQHSEPSNINRSDIPSVSCEPDKLSLRSPQESQSRQIRSCTKVHMQGIAVGRAVDLTRFDRYEDLLKKLEEMFDIQGELCGLTSIWQVVYTDDEDDMMMVGDDPWLEFCSMVRKIFIYTAEEVKRLSPKIKLPAMEEIKPGKLDSDVAVAGTDDQSSVVGPGC

SEQ ID NO: 206 - protein, 171 aa, Bacteroides thetaiotaomicron VPI-5482
MKKIGLFYATKADKTTWVAEKIQKEFGKDRIEVVPIEQAWQNDFAAYDCLIVGASTWFDGELPTYWDELLPELRTLDLKGKKVAVFGLGDQIRYPENFADGIGLLAEVFEGDGATLVGFTSSERYTFERSRALRGDRWCGLVVDLDNQSEQAEKRIREWCEQVKNEFDSKP

SEQ ID NO: 207 - protein, 169 aa, Triticum aestivum
MAAPRPKSPLDPCGRHRLQLAVDALHRQISFLEGEISSIEGLHAASICCKEVDEFIGKNADPFITISSEKGNADQSHRFPKKIRTRWACLSCFPWICGGGCSAVQLKGPSCCCGCPRCCVGSGGCGGGPSCGCSCSCAGCSSSCACPACAGCGAACCGGAPRPRCCLCS

SEQ ID NO: 208 - protein, 835 aa, Oryza sativa Japonica Group
MKQRLLVVANRLPVSANRRGEDQWSLEISAGGLVSALLGVKDVDAKWIGWAGVNVPDEVGQRALTRALAEKRCIPVFLDEEIVHQYYNGYCNNILWPLFHYLGLPQEDRLATTRNFESQFNAYKRANQMFADVVYQHYKEGDVIWCHDYHLMFLPKCLKDHDINMKVGWFLHTPFPSSEIYRTLPSRSELLRSVLCADLVGFHTYDYARHFVSACTRILGLEGTPEGVEDQGRLTRVAAFPIGIDSERFKRALELPAVKRHITELTQRFDGRKVMLGVDRLDMIKGIPQKILAFEKFLEENHEWNDKVVLLQIAVPTRTDVPEYQKLTSQVHEIVGRINGRFGTLTAVPIHHLDRSLDFHALCALYAVTDVALVTSLRDGMNLFAGAAQSLGAGAILVNPWNITEVADSIKHALTMSSDEREKRHRHNYAHVTTHTAQDWAETFVCELNETVAEAQLRTRQVPPDLPSQAAIQQYLHSKNRLLILGFNSTLTEPVESSGRRGGDQIKEMELKLHPELKGPLRALCEDEHTTVIVLSGSDRSVLDENFGEFNMWLAAEHGMFLRPTNGEWMTTMPEHLNMDWVDSVKNVFEYFTERTPRSHFEHRETSFVWNYKYADVEFGRLQARDMLQHLWTGPISNAAVDVVQGSRSVEVRSVGVTKGAAIDRILGEIVHSKSMITPIDYVLCIGHFLGKDEDIYVFFDPEYPSESKVKPDSSGSVSLDRRPNGRPSNGRSNSRNSQSRTPKAQAAPERSSSSSSSSQGTPNSHHDWREGSSVLDLKGENYFSCAVGRKRSNARYLLNSSEEVVSFLKEMADATAAHNGFQSTTADYMFLDRQ

SEQ ID NO: 209 - protein, 435 aa, Thauera sp. MZ1T
MKAVKTLELAAASPEPVIKAEAGAAAAPRPIRKSAKLAEVCYDIRGPVLVRAKQMEDEGHKIIKLNIGNLAAFGFDSPEEIQMDMIRNLPNAAGYSDSKGIFSARKAVMHYTQQKGIKGVTIEDIYIGNGVSELIVMAMNALLDAGDEVLVPAPDYPLWTAAVSLSGGKPVHYLCDESKGWLPDIDDMRAKINANTRAIVVINPNNPTGAVYPDETLKQIVALAREHDLILYADEVYDKVLYEGVRHTSMAALSEDVLTIIFNGLSKNYRSCGYRAGWMVVCGDKRRANDYIEGLNMLASMRLCANVPGQYAIQTALGGYQSIDDLVAEGGRMRRQRDLAWELINQIPGVSCVKPQATLYMFPRLDPKVYPIEDDQAFIAELLEEERVLLVQGSGFNWPHPDHFRLVFLPHEDDLRDAIGRIARFLENYRKRHGT

SEQ ID NO: 210 - protein, 861 aa, Gossypium hirsutum
MASRSCANFLHLASGNLLDIPQTPRGLPRVMTVPGIISDMDSCSSNDGDSDVASSGCRERKIIVANMLPLHAKRDRETSKWRFSWDEDSLLLHLKDEFSPEMEVVYVGSLKVDIDVNEQEEVAQKLLEDFNCVPTFVPHDLQKKFYLGFCKQHLWPLFHYMLPMCPDHGDRFDRILWQAYVSANKIFADKVMEVINPDDDYVWIHDYHLMVLPTFLRKHLNRIKLGFFLHSPYPSSEIYRTLPVRDEILRGLLNCDLIGFHTFDYARHFLSCCSRMLGLDYESKRGHIGLDYFGRTVFIKILPVGVHMGRLESVLNLSSTAARVKEIQKQFEGKKLILGIDDMDIFKGISLKLLAVEQLLQQHPDLQGKIVLVQIVNPARGFGKDVQEAKKETYMTAKKINEVYGSPNYQPVILIDRPVPRYEKSAYYALAECCIVNAVRDGMNLVPYKYIACRQGTPGMDEALGVKPEYPRTSMLVVSELIGCSPSLSGAIRVNPWDIDAVAEALNTAITKPESEKQLRHEKHYRYVSTHDVAYWARSFVMDLDRACQDHYSKRCWGIGLGLSFRVVSLSPSFRRLAIDHICSAYRRTNRRAIFLDYDGTLVPEASIIKTPSPEVICIIKTLCDDPKNTVFIVSGRGRASLSDWLAPCEKLGIAAEHGYFIRWSKDSEWETSPVGADLEWKKIVEPVMSLYREATDGSSIETKEGGLVWHHLDADPDFGSCQAKELLDHLESVLANEPAVVHRGQHIVEVKPQGVSKGLVAEKVLSRMVNGGKPPDFVMCVGDDKSDEDMFQSILTSVSNPSLPVAPEIFACTVGRKPSKARYYLDDTADVLKLLKGLATATISKPRCLPEIKVSFESNA

SEQ ID NO: 211 - protein, 861 aa, Gossypium hirsutum
MASRPCANFLHLASGNLLDISQTPRGLPRVMTVPGIISDMDSCSSNDGDSDVASSGCRERKIIVANMLPLHAKRDRETSKWRFSWDEDSLLLHLKGGFSPETEVVFVGSLKVDIDVNEQEEAAQKLLEDFNCVPTFLPHDLQKKFYLGFCKQHLWPLFHYMLPMCPDHGDRFDRILWQAYVSANKVFADKVMEVINPDDDYVWIHDYHLIVLPTFLRKHLNRIKLGFFLHSPFPSSEIYRTLPVRDEILRGLLNCDLIGFHTFDYARHFSSCCSRMLGLDYESKRGHIGLDYFGRTVFIKILPVGVHMGRLESVLNLSSTAARVKEIQKQFEGKKLILGIDDMDIFKGISLKLLAVEQLLQQHPDLQGKIVLVQIVNPARGFGKDVQEAKKETYMTAKKINEVYGSPNYQPVILIDRPVPCYEKSAYYALAECCIVNAVRDGMNLVPYKYIVCRQGTPGMDEALGVKPEYPRTSMLVVSEFIGCSPSLSGAIRVNPWDIDAVAEALNTAITMPESEKQLRHEKHYRYVSTHDVAYWARSLVMDLDRACQDHYSKRCWGIGLGLSFRVVSLSPNFRRLAIDHICSAYRRTSRRAIFLDYDGTLVPEASIIKTPSPEVISIIKTLCDDPKNTVFIVSGRGRASLSDWLAPCEKLGIAAEHGYFIRWSKDSEWETSPVGADLEWKKIVEPVMSLYREATDGSSIETKESGLVWHHQDADPDFGSCQAKELLDHLESVLANEPAVVHRGQHIVEVKPQGVSKGLVAEKVLSRMVNGGKPPDFVMCVGDDKSDEDMFQSILTSVSNPSLPVAPEIFACTVGRKPSKARYYLDDTADVLKLLKGLATATISKPRCLPEIKVSFESNA

SEQ ID NO: 212 - protein, 177 aa, Pantoea agglomerans
MATIGIFFGSDTGQTRKVAKLIHQKLDGIADAPLDVRRATREQFLSYPVLLLGTPTLGDGELPGVDAGSQYDSWQEFTNTLSEADLSGKTVALFGLGDQLNYSKNFVSAMRILYDLVIARGACVVGNWPREGYKFSFSAALLENNEFVGLPLDQENQYDLTEERIDTWLDKLKQAVL

SEQ ID NO: 213 - protein, 608 aa, Gaeumannomyces graminis var. tritici
MKFLVVSLFALVCGSAALATPANSSVSSSSGQHHPKPHHPHQPLDSGCKNGPKSRNCWGKHSIDTNYYETAPDTGVTREYWLSVEEGICNNDGYKRYCQTFNGSFPGPLIWANWGDNLVIHVTNNMKTNGTAIHWHGLHQRGSVEYDGVPGVTQCPIAPGKSLTYKFRVTQYGTTWYHSHFSLQYTEGLFGPMIFYGPTTANYDEDLGTLFLQDWDHDTAWHGWENVASKGAGPLPANGLINGTNTFDCKNSTDTNCLGGGKKFSATFKKGKKHLIRIINNSADAHFQFSIDGHSLIVVSNDLVPIKPFKTQSVRVSIGQRYDVIVEANAKPGDYWLRSGMSCVPGDTGALRERVTGIIRYDKKSKADPKTTSDVVVDETCSDEDPKKLVPHVALDVTHMGEIVQSDLGFKPNGTPAEGQNWFQWTLNNSSLVLDWHDPTLERIFDRQSIFPTKYNVIKAEPPATAPASKWFTLVIQSNEILLTPLPSHSLTHPIHLHGHDFWVLSQSKAKWDGTPRGFNTKNPARRDTAMLPAGGHLAIAFQLDNPGAWLVHCHIAWHAGQGLSLEFVESQGRIALGMPDHHVFQQTCREWDAVRNKMPFPQHDSGI

SEQ ID NO: 214 - protein, 581 aa, Gaeumannomyces graminis var. tritici
MKSFGLIKGLALLAGLVASAPVASRDESLDLFPQLAGLRASTSTRDYESNTPNTGVTRRYNLVVTEVDNYVGGDGLVKSKAMLINNQFPGPIIKADWGDWVEVTVTNRLRTNGTSMHWHGVRMLNNNPNDGANGITECPIPPNASKVYRFRVEQYGTAWYHSHFSGQYGNGVVGTLLFNGPASLPYQEDLGVYPITDWYYRGADEIQFSLIPSPGVPPPSDNILFNGSHVNAQGGGSYNRVKLKPGRRHRLRIINTSVDNTFTVSLVGHQFTVIQTDFVPVNAFTTSQIFLGIGQRYDVTIEANQPVGNDWFNVTFAASGLCGTSLIQKPASIFQYEGASDTALPTNPGPTPTESLCEDLNSWTPVVAKNVPRASFSAVPGNTLEANTNVENWEGRQRVYWEINGSDMNITWDEPTLEYLVKGNMNFPQNFNVFQVPQGNQWSFWIIQNPTVAPHPMHLHGHDFYLLGRSPAQTNPFAGPVRRFNAATDLATLRFDNPVRRDVTMLPANGWIVVAFRTDNPGAWLFHCHIAWHVAQGLSVQFLERVQDIPSAFPLSAIEPTCSQWTAYYATSPHKQHDSGL

SEQ ID NO: 215 - protein, 172 aa, Colwellia psychrerythraea 34H
MKIGLFYGSTTCYTEIIAEKIQAIMGADLVDIFNIKDQPLALCLDYDFIILGISTWDYGELQEDWESMWSDISQIDLSDKIIALYGMGDQVGYTEWFQDALGMLHDQVIAQGGTVVGYWPNQGYDFTASKALTADGSQFVGLSLDEDSQYNLTDERLDTWCEQVLLEYSSLL

SEQ ID NO: 216 - protein, 404 aa, Pasteurella multocida subsp. multocida str. Pm70
MAHFPKSDKLEHVCYDIRGPVHKEALRLEEEGHKILKLNIGNPAPFGFEAPDEILVDVIRNLPTAQGYCDSKGLYSARKAIVQYYQSKGIHGATVNDVYIGNGVSELITMSLQALLNDGDEVLIPMPDYPLWTAAATLAGGKPVHYLCDEEANWFPDVNDIKSKITKRTKAIVVINPNNPTGAVYSQDLLLEIIEVARQHKLIIFADEIYDKILYDDAVHHHIAALAPDILTVTFNGLSKAYRVAGFRQGWMILNGPKKAAAGYIEGLDMLASMRLCANVPMQHAIQTALGGYQSINEFILPGGRLLEQRNKAYELINQIPGVSCIKPQGAMYMFPKIDIKKFNIYDDEKMVFDLLAQEKVLLVHGRGFNWHSPDHFRIVTLPHVHQIEEALTKLARFLAHYHQ

SEQ ID NO: 217 - protein, 876 aa, Kluyveromyces lactis NRRL Y-1140
MTGEKKLSNKVINCITQLPYKIEKISDDDTEANDPSCWSIEPISGNSALQSSLKYLNESPNWEHHIVAWTGEILNSDENPDRSMYLTQAEKEVIATMLQGKEAEGCTHTVHPVWLLRKDQYRWRKFAENVIWPALHYILNAPDDGTLENVWWYDYVKFNEAYAMKVAQIYQPGDIIWVHDYYLMLLPQLLRMRFNNATIAYFHDTPWPSNEYFRCLSRRKPVLDGLLGSNRICFQNDGFARHFVSSCQRLLGCTATKSSNSNANNSDEYRITSYGGDVLVDSLPIGVDTEQIQRDAFSPDVDEKVNAIKKAYEGKKIIIGRDRLDTVKGVLQKLQAYQVFLAMYPEWRGKVVLIQVSGPTAKTDANIKLESQVNELVSSINGEYGNLNYSPVQHYYLRIPQDVYYSLLRVADVCLITSVRDGMNTTALEFVTVKSQLSKYNCYASPLILSEFSGTSTILTDAIIINPWDAVAVSKAINKALKLTPEQKETLELKLRKEVPTIQDWTDKFLGKVVDLVEHKIGNQKITPALNRPLLLKTYKKAKRRLFLFDYDGTLTPIVQDPAAAIPSARLYSIITKLAQDPKNKIWLISGRDQQFLNRYFGTKIPQVGLSAEHGCFMKDVSSEEWINLTSKFDMSWQKEVGQIMEEYTKKTPGSFIERKKVALTWHYRRSDPQLGEFNADALKTSLEKITDGLGVEVMEGKANIEVRPSFVNKGEIVKRLVWTPHGAKQLIEDNFSIDENVLRDELPEFVLCLGDDVTDEDMFKQLNHIEEQWDEKYPNFESSDGFGIYPVTVGSASKKTVAKAYLTDPQQVLDTLGLLVGDVSLFQSAGTVDLDDRGHLKDSESSLRSEQASAAYAMKRSTSSNNGLKKSSKNN

SEQ ID NO: 218 - protein, 174 aa, Prochlorococcus marinus str. MIT 9313
MAVGIYFATTTGKTEDIADRLHPLLNGTNTPQDLADLQDLSPLNDLDAIICGIPTWNTGADSERSGTAWDSMLEGISKLSLSGKQVAIYGLGDSSTYTENFCDAIEELHQCFKNAGATMVGYVSKDGYTFEDSKSLIGDKFCGLPLDEDSESDMTDDRLMSWAIQLKQEIPALN

SEQ ID NO: 219 - protein, 151 aa, Bacillus licheniformis ATCC 14580
MMGKVLLVYASMSGNTEAMADLIEKGLLEGGAEVDRHEAMDVDAALFNDYQHMIFGAYTWGDGELPDEFLDIYDDMEGMDFIGKTFAVFGSGDTSYEHFCGAVDILEDKIKELGGNVVLPSVKIEMNPEDEEEGMLLQFGRDFAKKCEVPA

SEQ ID NO: 220 - protein, 401 aa, Pyrococcus horikoshii OT3
MTLMIRASKRALSIEYAIRDVVLPARELEKKGIKVIRLNIGDPVKFDFQPPEHMKEAYCRAIQEGHNYYGDSEGLIELREAIVKREKEKNGVDITPDDVRVTAAVTEALQLIFGALLDPGDEILIPGPSYPPYTGLVKFYGGKPVEYRTIEEEGWQPDIDDLRKKISERTKAIAVINPNNPTGALYDKKTIEEIINVAGEHDLVVLSDEIYDLMTYEGKHISPGSLTKDVPVIVMNGLSKVYFATGWRLGYMYFVDPEGKLSEVREAIDKLARIRICPNTPGQFAAIAGLTGSMDYLKEYMKKLKERRDFIYKRLNEIPGISTTKPQGAFYIFPRIEEGPWKSDKEFVLDVLHNAHVLFVHGSGFGEYGKGHFRIVFLPPIEILEEAMDRFEKFMRERLSS

SEQ ID NO: 221 - protein, 459 aa, Burkholderia sp. 383
MSRLIIVSNRVAPISEGEPAAGGLAIGVYDALKETGGMWFGWSGEVVASGAPQIRVEEHGPVTFATIGLSRRDYDQYYRGFSNATLWPAFHYRTDLIQYDRHEFEGYSRVNVWLAQQLVPLLQDDDVIWVHDYHLIPFARALRAAGVKNRIGFFLHIPFPAAQVLVNVPPHRDLVESLCAFDLIGFQTEPDLRAFCDYVESEADGVIERDGHLATVRAFGRTLRAAAYPIGVHPDEIASLAQAGEHGKAVRTLAISLRGRKLIMSVDRLDYSKGLVERFRAFEKLLEHEPSHRNRVSFLQIAPSTRAELRAYQDIRLQLEGESGRINGRFAELDWAPILYIHRQYDRQLLAALYRLARVGYVTPLRDGMNLVAKEYVSAQNPEDPGVLVLSRFAGAARELTGALIVNPIDIDGMADALSQALTMPLAERRARYTDMIAQLRENNVSVWRDNFLRDLQHA

SEQ ID NO: 222 - protein, 69 aa, Arabidopsis thaliana
DVFYFLKLVETTGISTVPGSGFGQKEGVHHLTTTIPPAEDKTPNIMDSFKKFNDDFMTQYDNNFDYSKM

SEQ ID NO: 223 - protein, 404 aa, Photobacterium profundum SS9
MHNIGMSSKLNNVCYDIRGPVLKHAKRMEEEGHKILKLNIGNPAPFGFDAPDEILVDVIRNLPTSQGYCDSKGIYPARKAIVQHYQKRGLLDLDVEDVYIGNGVSELIVMAMQALLDNNDEILVPSPDYPLWTAAVSLSGGNPVHYICDEESDWYPDLDDIKKKITPNTRGIVLINPNNPTGAVYSRDFLLEIVEIARKHKLIIFADEIYDKILYEGAQHTSIAPLAPDVFCITFNGLSKSYRVCGFRAGWMVLSGPKHEAKGYIEGLEMLSSMRLCANVPMQHAIQTAIGGYQSINELILPGGRLLEQRDKAYDLITQIPGVSCVKPKGALYLFPKLDQKKFNIVDDQRMALDFLQQEKVLIVHGTGFNWEKPDHFRIVTLPRVDDLEMAIGRLERFLHNYRQ

SEQ ID NO: 224 - protein, 174 aa, Aggregatibacter actinomycetemcomitans
MAVVGLFYGSDTGNTENIAKMIQKQLGSELVDIRDIAKSSKEDIEAYDFLLFGIPTWYYGEAQCDWDDFFPTLEQIDFTDKLVAIFGCGDQEDYADYFCDAMGTVRNIIEPHGAIIVGNWSTEGYSFESSQALIDNDTFVGLCIDEDRQPELTSERVNKWVKQVYEEMCLAELA

SEQ ID NO: 225 - protein, 404 aa, Shewanella sp. ANA-3
MRPIIKSNKLDTVCYDIRGPVHKEARRLEDEGHRILKLNIGNPAPFGFEAPEEIVRDVILNLPSAQGYCESKGLFSARKAIVQHYQAQGIKGVDIEDVYIGNGVSELIMMAMQGLLNTDDEVLLPSPDYPLWTAAANLAGGKAVHYRCDEEADWFPDLDDIKSKISSRTRGIVLINPNNPTGAVYSKELLLQVIELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLRDKKILLVHGSAFNWPEPDHLRVVFLPYKEDLTKALTEFGNFLETYKQ

SEQ ID NO: 226 - protein, 220 aa, Zea mays
MSPSSALAQASVRSLCARGSRARQSGGNVGSRVLYTPFTSSTPLHHPLLRPSSPARPAHFSSHRPHTRTIMSKAPGKVLNIGNINPHVKAAQYAVRGELAVKSEEYRAKLAKGEGSDLPFDTVIAANIGNPQQLDQKPITFFRQVASILENPGLLEHEDVLLNSLGYKSDVVDRARKLLKEVKSVGAYSQSQGAPGIRQSVAEYIERRDGYPAQFEDIYL

SEQ ID NO: 227 - protein, 71 aa, Oryza sativa
  misc_feature (2)..(2): Xaa can be any naturally occurring amino acid
  misc_feature (9)..(9): Xaa can be any naturally occurring amino acid
  misc_feature (12)..(12): Xaa can be any naturally occurring amino acid
  misc_feature (22)..(22): Xaa can be any naturally occurring amino acid
  misc_feature (61)..(61): Xaa can be any naturally occurring amino acid
MXGGGGMFXRKXLDYEVLIENXKKVQYAVRGELYLLASELQKEGKKIIFTNVGIPHFLGLXPLTFPRQVVA

SEQ ID NO: 228 - protein, 567 aa, Phanerochaete flavidoalba
MRIALAALPALLTVMVGLHGGEVHAGPHGQYAGVSARSELHARDTVSLPSSSDIILNGLQGQAPQTRNYDFVVSEMTGAPDGFSKSMLVVNGQFPGPTIEANQGDRLVIKVTNQLTTNRTTIHWHGLYQNGTVWYDGTASVTECGIPPGESLTYDFEPGSFSGTTWWHSHYDTQYTDGVTGALIIHPSADPPADFPTYDEDFVVQLTDIYHTLSPAIVQNYLSGTGPTAPIILETPDSGSINGVGQYGGEGDYFNFTLEANKTYRLRLIHTGSAAQIRFSVDYHALTVIEADGTLVEPYSVTGVNLNVAQRYSVLLTTNQTEGNGTYWMRAGLTSVVAVEGTTSDIRGVIRYGTNDTSLPTADTDPGVPDSGLADMDVSLLTPAIVDTPPDRSRFYQVGFNISTTSTGGTIAYVNGTSWAPLVGTNSLLQINQNSSYAGEGESVDSGDQFIITEDTIETVDILLINQGAGDHPFHLHGHSPWILGFDSTTYQGQTPNPTNPLRRDTFVVPSGGWLMLRYISDNPGPWTMHCHIAWHMAAGLLMQVNSLPSVVAGWTIPQDVVDQCSA

SEQ ID NO: 229 - protein, 716 aa, Cypripedium parviflorum var. pubescens
LSFHYMLPLSVPPWRHELKRSLWESYVLANKIFSQKVIEVINPEEDYVWIHDYHLMALPTFLRRRFNRLRMGFFLHSPFPSSEIYRTLPVREEILKALLNCDLIGFHTFDYARHFLSCCSRMLGMEYQSKRGYIGLDYFGRTVGIKIMPVGIQMAQLQLTLSLPDKAWRVSELQQRFLVKLFCLVLMTWTFSKASISSSLHLSRCSRYIPSGRGMRFLCRLLILLGAREGTLRRFKQRFGKAAKRINEQFGNANYNPVVFIDLPISLEERVAFYTIAECVVVTAVRDGMNLTPYEYIVCRQGIISGSDSSLEADGPKKSMLVVSEFLGCSPSLSGAIRINPWNTESTAEAMNEAISMSDAEKQLRHEKHYRYVSTHDVAYWSKSFMHDLERTCKDHFKRRCWGIGLGFGFRVVALDPNFRKLNIDAIVSAHERAKSRAILLDYDGTMMPQMPINKTPSAEIISIINTLCGDKKNVVFIVVVEEWCNLEKWFSPCRKLGLAAEHGYFTRWSRDESWEICSQSSDFEWMQIAEPVMKLYTESTDGSYIDKKESALVWHHHDADPDFGSAQAKEMLDHLESVLANEPVSVKSGQFIVEVKPQGVTKGIVVEKILSSMVNYNKQADFLLCIGDDRSHEDMFECISAILSKDLVAPNTTSVCFHKWDRNRAKARYYLDDTVEVTNMLGALADSSQPSSPISDVKLESLSFSEMAAKPNMST

SEQ ID NO: 230 - protein, 446 aa, Thermoplasma volcanium GSS1
MRYVIASSRCPFSHDVVMGRELVKENVGGVATALKRAISKHGGTWICWGDGKADNRYVNEDVGTYKIKRIILTPQEKRGYYDMYSNRTLWPLFHYFRERVQYTDNGYETYRKVNEKFAEEILNNTSQEDIVWVHDYQLSLVPGILRQKGLKNRIIFTWHIPWVSREMFETLTESDEIKESVGSADFITFHTDLYRKNFESLFENRKHGKSIAVPLGIDYRYFEKAKSSQIKSYALKDKIMLFSIDRLDYTKGLTNRVLSIERLIRNHPETSGKFVYVMIVTPSRTSVSDYVSMKRELEMNIGRVNGEFGTISWMPILYMYRKISDHSLVSYYKSADIALITPLIDGLNLVSKEFIASTEKGILVLSKFAGASNCLRGALIVNPNSPDEVADAIYKAMNMERKEADERLLKMKAIVKARDTDWWIKRIYRLAIAKEHDRRVTNNRIE

SEQ ID NO: 231 - protein, 404 aa, Mannheimia succiniciproducens MBEL55E
MELFPKSNKLEHVCYDIRGPVHKAALRLEEEGHKILKLNIGNPAPFGFEAPDEILIDVIRNLPTAQGYCDSKGLYSARKAIVQYYQSKGIHGATVNDVYIGNGASELITMAMQALLNDGDEVLVPMPDYPLWTAAVTLAGGKAVHYLCDEEQDWFPAIDDIKSKITSRTKAIVIINPNNPTGAVYSKELLLEIAEIARQNGLLIFSDEIYDKILYDGAVHHHIAGLAPDLLTITMNGLSKAYRICGFRQGWMILNGPKDKARGYIEGLDMIASMRLCANVPMQHAIQTALGGYQSINELIVPGGRLYEQRNRAYELLNQIPGVSCVKPMGALYMFPKIDIKKFNIYDDEKLVLDLLAQEKVLLVHGRGFNWHAPDHFRIVTLPYVHQIEEALNKFARFMENYHQ

SEQ ID NO: 232 - protein, 434 aa, Chromobacterium violaceum ATCC 12472
MKQPHRQRKTVPSGGRPETETAAAMQPVHKSQKLANVCYDIRGPVLEHAKRMEDEGHRIIKLNIGNPAPFGFFAPDEIIEDVIVNLPAASGYSDSKGLFAARKAIMHYAQQKHLPNVAMDDIIVGNGVSELIVMAMQALLDNGDEVLVPAPDYPLWTAAVSLAGGKAVHYLCDEEQGWFPSIDDIRAKITPTTRAIVIINPNNPTGAVYPPALLQQIVDVARQHQLIIYADEIYDKVLYDAVRHTSIASLAPDLFVVTLNGLSKNYRACGYRAGWMILSGEKKHAKDYIEGLNMLASMRLCANVPSQYAIQTALGGYQSIDDLVAPGGRLARQRDLAHKLLTEIPGVSCVKPQGALYLFPRLDPKVYPIADDQQFILELLQQEKVLLVQGSGFNWIAPDHFRVVFLPNSDDLIEAIGRIARFLESYRKRHGAAE

SEQ ID NO: 233 - protein, 271 aa, Karenia brevis
MRAIVISLTCLACGGYGRRVHPQRDSLEKGASRLEAFVMDGSKLAQKGMQERLERQAANGKEAKLCQVLAATNPAAAFQAAGTGISTPLRARRVGMSPGMSVGLYYSTSTGNTETVAEYIAGAAGIEDWKDIGDADDAEITGHDAIIVGAPTWHTGADSERSGTSWDEWLYNTLPNLDFSGKKVAIFGVGDSGSYSDNYCDAAGELYDLFTGKGAKVFGMTPSDEGYDYTESKSVVDDKFVGRMFDEDSYSDESEERAKSWVEQLKSEGFM

SEQ ID NO: 234 - protein, 156 aa, Glycine max
  misc_feature (106)..(106): Xaa can be any naturally occurring amino acid
TRPATGWGLEIPELKKQLEAAKSKGINVRALVVINPGNPTGQVLGEANQRDIVEFCKQEGLVLLADEVYQENVYVPEKKFHSFKKVSRSMGYGENDITLVSFQSGXRGGYMEVTGFSAEVREQIYKVASVNLCSNISGQILASLVMSPPKVNSLHL

SEQ ID NO: 235 - protein, 176 aa, Salmonella enterica subsp. enterica serovar Typhi str. CT18
MAITGIFFGSDTGNTENIAKMIQKQLGKDVADVHDIAKSSKEDLEGYDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTAERVEKWVKQVSAELHLGDILNA

SEQ ID NO: 236 - protein, 379 aa, Arabidopsis thaliana
YSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 237 - protein, 624 aa, Cryptococcus neoformans var. grubii
MRGVVKLFFLSCSLVSLVSSEETGKSPTANYDHYMPKATATIDPSVFALSNDFEITDVPTTREYTFDITKALASPDGYEREVYVVNNMFPGPVIEANTGDTIIVHVNNHLEEGQSIHWHGLRQLGTAFMDGVPGITQCPIPPGSSFTYQFTVSHQSGTFWWHSHYSNSMADGIWGPLIIHSPNEPLQRGRDYDEDRIVFITDWVHDNSEVVIAALATPEGYKGSPAPPQGDAILINGRGQTNCTATGSSSCTYPPPPEIHVPVNCRVRLRFISATAHPMYRITIDNHPLEVVETDGTAVYGPTVHEISIAPGERYSAIINTSEGKEGDAFWLRTSVALGCMFGGIDQVGLAVVRYTGNGMVSTEEPQTTAWSDLAGATTPCAGLDQTYTLSPRESFSAPREFSQSHVFNSQRGAFVNVYGNTFQGYGFNNISYQNQIFNPLLSIVQRGGSCESTLVASTTFPDLGSGNIIINNLDGVIDHPYHLHGNEFQVIGRGTGALSLDNLTNIDFNLDNPVRKDTLWIQGGSWVVLRITTDNPGVWALHCHIGWHLTEGKLAVVVIQPGAIGHMEGPESWTNLCANTDPNAFGPARRSPSPSIQSSKTSIFQYLREVKGKVVKRRGAREA

SEQ ID NO: 238 - protein, 727 aa, uncultured archaeon GZfos33E1
MRRLLIISNRLPVSVERRKNEFRFSSSVGGLATGLNALHQRYESVWVGWPGIAINREENDYVESKLSEFNCYPVFLSQGEVEKYYYGFSNKTLWPLFHYFPQYAKYEYAEWSAYEHVNRKFCERVAEIAKPEDVIWIHDYHLMLLPGLIRGRFPDATIGFFLHIPFPSADLFRLIPWRRRILEGVLGADFIGFHTYDYAHNFLSSVLCLLGYEHELGKFAIGDRIVQVDVHPMGIEVQKFVSATSGRGIKREVARLRSRFKNCKIIFSMDRLDYTKGIPERLYAFEHFLETHPEWHEKVVFILKIAPSRTKVGQYRVLKQEIDELVGRINGKYGTPEWVPISYFYRSLPFQTIVAFYLAADVALLTSMRDGMNLIAKEFVASRVDGKGVLILSEMAGAARELGEALVVNPNNKEEVAEALNEALRMPEEEQKSRNEEMQKRLSHYDVFHWGSGFIRSVLETKRLQEELNMKKLNEKIREELKNSYKAADKRLLLLDYDGTLVPFADKPERAKPDKELLYIFRALSEPPENTVVIISGRDKETLERWFGDTGVCLVAEHGVRLREEEGEWEEIELLKEDWKEKIISILDLFVDRAPGSFIEEKSFSLVWHYRNVDPELGELRAKELTDQLIGLTACTELQVMKGNKVVEVKDGRVNKGIAASHWLTKGFGFILAVGDDLTDEDMFKVLPEGAYSVKIGFTPSKARFYLGSPKEVRALLDEMEMVEVYK

SEQ ID NO: 239 - protein, 124 aa, Oryza sativa
FSIKEGLKKEKVAEKMSNEHFLTMDNLSPAVKNVQYAVRGKVVIRAAEIEKELKNGVSKPFERVIRANIGDCHATGQKPITFLRQVMALCSYPALLDSKEFPEDAKAKARKMLAACAGGSVGSY

SEQ ID NO: 240 - protein, 405 aa, Aeropyrum pernix K1
MPQKDPTLDIQERVVEIEGETAFAYLAVARKLIQEGRRVISFGIGQPDFPTPHHIREAAKKALDEGFTGYTETAGIPELREAIAWYLNSRYGADVSPEEVIATTGAKTAIFLGMALYLRPGDEVIIPDPSYYAYAQVAKLFGARPVYVPMKFEPGLGFRFDIEGIERAVSEKTRMIVVNNPHNPTGSVFPPDQVEAIHDIARRRGLIILADEIYDNFLYTEKPFKSTLSLPDWRENLVYVNGFSKTFSMTGWRLGYVVLRREVIPKALDLAVTIYSCPPSIAQKAGVAALRGDWGPVREMVEEFRSRARILYDILSQAEGIEPYLPEGAFYMFPRVAGLLRKTGLSVEQLAEKLLYSYGVLVLPGTSFPESVGREHVRLSFATATSDVKEGAEIIVRASRELSSG

SEQ ID NO: 241 - protein, 388 aa, Verrucomicrobium spinosum DSM 4136
MDFISKNVSELAPSLTLSITSQAKALKKQGVDVLSFGAGEPDFNTPAHITEAAIKALQDGQTRYTESSGLIELREAISAKFEMDNGLKYSPSQISVNCGAKHSCYNAILAVCNPGDEVIIPAPYWTSYPEMVRLVGAVPVIVETKAEDGWKITPEQFEEAMSPLTKMIILNSPGNPTGSVYSKDELEKIAEIAVGEDIVILSDEIYEKLVYGDNKHISIASLGKEVSDLTITVNGFSKAYAMTGWRLGYTAAPKAIADAIDTIQSHTTSNPTTFAQYGAIAALNGDQQIVADMREEFNVRREFMLGRLQGIKNIRVVEPWGAFYFLVNIEPIGIKSVNFAEKLLSKQKVAAVPGIAFGEDYTIRFSYATSLDVINAGMDRFEEFCNQH

SEQ ID NO: 242 - protein, 164 aa, Helicobacter pylori 26695
MGKIGIFFGTDSGNAEAIAEKISKAIGNAEVVDVAKASKEQFNSFTKVILVAPTAGAGDLQTDWEDFLGTLEASDFATKTIGLVGLGDQDTYSETFAEGIFHIYEKAKAGKVVGQTPTDGYHFEASKAVEGGKFVGLVIDEDNQDDLTDERISKWVEQVKGSFA

SEQ ID NO: 243 - protein, 154 aa, Bacillus cereus ATCC 14579
MLEGDAKVAKILIAYASMSGNTESIADLIKVSLDAFDHEVVLQEMEGMDAEELLAYDGIILGSYTWGDGELPFEAEDFHDDLENIDLAGKKVAVFGSGDTAYELFCEAVTIFEERLVERGAELVQEGLKIELAPEDEEDVEKCSNFAIAFAEKF

SEQ ID NO: 244 - protein, 1110 aa, Ashbya gossypii ATCC 10895
MVVIVASLFLPFQPQFEISTSRTEAAALVDSQVVKIPALGGPAESANVVLKAKRASSSHGLTSPFVGPTEQNSGSDDVTDASKTGARGGISSQLLMENITSNVNSAAGTPGAQLGNHGNTSVEEFFASGGTARARDADPGSEVYSTASSPAGESSSSVQPGAVLNNADSTANLLKNVNKKLLYQSVLAGSLSTSALEGHKSTTSSNAHSTVITPRSRQLPDVASSVTNVPKGKAMRQMPVRRLLHRKSSSSIATVHSNLKYPLNINDYDEESVEEEGGRQSSLPHMPYKEAEEQESSDEEELDLDENGNRKNAVPKFGGYSNTARIRAQLMMNSQNIFKTAPWKIVPSSKGNGGLKNALTTALVEKTIEQPVTWIGTVGIPTDAVPPDVLKGITEQLDEAFDSKAVITDDITFKSAYQNFCKKILWPTLNYQIPDNPNSKAFEDHSWNYYQHLNQQFADKIVESYKDGDLVWVHDYHLMLVPEMVRKKLPTAKIGFFLHVSFPSSEVFRCFAQREKILEGILGAHSIGFQTEEYARHFQQTANRLLMCDVADRILRYKGRIIAIESTPIGVDAFDLEVQLKSQETLEWRRLIRERWAGKKLIVSRDQFDRIRGLRKKMLAYERFLKLNPEYIDRVVLIQVCLGSGRDSEMEREVMTVVDRINALSRDISVSQPVVFLHQDLQFPQYLALNCEADMFLVSTMREGMNLTCHEFVICSQEKNAPLLLSEFTGSARVLGSGSLLINPWDIRQVADTIKVGLELSKEQRRRKWKQMFKSVIMHDSDNWMASSLASINNSWEANRERSKVFNLSLDKILDSYETARRHIFILKLSEPPTARMVTVLSELCTRSAVFIINSFSRSMLERLYCRVPNIGLIAENGAFVRLNGIWYNMVQDVSWKEDIIKVIEDKVERLPGSYYKVGETMIRFHTENAEDQDRVSNVVGDAITHVNTLFGDNGIHAYVHKNIVFVQQSGLSVQALRFLLNHYNSVDDTPGSTPAHSPAVSPVMTPVNSSLAMSPSTAASKTPSAATATASYFSNGRSTSRVEFVCVTGTSSPVLEPLFQSINELAKKGDLPYGYTVAYGDAITTYAKEHVEGSNELFGILDKLTFIGC

SEQ ID NO: 245 - protein, 526 aa, Triticum aestivum
  misc_feature (99)..(99): Xaa can be any naturally occurring amino acid
  misc_feature (229)..(229): Xaa can be any naturally occurring amino acid
  misc_feature (245)..(245): Xaa can be any naturally occurring amino acid
  misc_feature (248)..(248): Xaa can be any naturally occurring amino acid
  misc_feature (277)..(277): Xaa can be any naturally occurring amino acid
  misc_feature (284)..(284): Xaa can be any naturally occurring amino acid
  misc_feature (288)..(288): Xaa can be any naturally occurring amino acid
  misc_feature (290)..(290): Xaa can be any naturally occurring amino acid
  misc_feature (297)..(297): Xaa can be any naturally occurring amino acid
  misc_feature (305)..(305): Xaa can be any naturally occurring amino acid
  misc_feature (312)..(312): Xaa can be any naturally occurring amino acid
  misc_feature (315)..(315): Xaa can be any naturally occurring amino acid
  misc_feature (318)..(318): Xaa can be any naturally occurring amino acid
  misc_feature (322)..(323): Xaa can be any naturally occurring amino acid
  misc_feature (343)..(343): Xaa can be any naturally occurring amino acid
HFRTSLYKKAGWHRSGIPGISSTHASGEIVIHAQRLQQQLQTQPGSLPFDEILYCNIGNPQSLGQQPVTFFREVLALCDHPDLLKKEEIKTFLWAPRPXSRAKQILALIPGRATGAYSHSQGIKGLRDAIASGIASRDGFPANADDIFLTDGASPGVHLMMQLLIRNEKDGILVPIPQYPLYSASIALHGGSLVPYYLNESTGWGLEISDGKKQLEDARSRGIDVRAFXWLSIQGNPTGPGTWLXENXNMTIVEVSAKNEGPWFFLAGRGNTQKNIXTPDNKKXHSFXKXVRSLDPXGGLLYIFXLSKDIWXGEXGVXEYAXXHKNHFTMLLDFVHSRLAATXGPYGECGKRGGYMEITGFSAPVREQIYKIASVNLCSNITGQILASLVMNPPKASDESYASYKAEKDGILASLARRAKALEIAFSKLEGITCNKAEGAMYLFPQICLPQKAIEAAKAANKAPDAFYALRLLESTGIVVVPGSGFGQVPGTWHFRCTILPQEEKIPAIISRFTVFHETFMAEYRD

SEQ ID NO: 246 - protein, 624 aa, Cryptococcus neoformans var. neoformans B-3501A
MRGLAKLFFLSCSFVSLVSSEKTDESPTAVSDNYMPKATATIDPSVFALSNDFEITDVPTTREYTFDIAKAFASPDGYEREVYVVNNMFPGPVIEANTGDTIIVHVNNHLDEGQSLHWHGLRQLGTAFMDGVPGITQCPIPPGGSFTYNFTVSHQSGTYWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISVAPGERYSAIINTNEGKEGDAFWLRTSVALSCMFGAVSQEGLAVVRYTGNGMVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPAKRSSSPSIQSSKTSSFQYLREVKGKVVKRRGAREA

SEQ ID NO: 247 - protein, 455 aa, Xanthomonas axonopodis pv. citri str. 306
MSRLVVVSNRVAVPGENRAGGLAVGLLAALKERGGVWFGWSGKTVRGDSGGMHEQTEGDITFVTMDLNKRDIDSYYNGFANRTLWPLLHFRLDLVDYDRATREGYMRVNRLFAEKLAPLLKDSDTLWIHDYHMIPLGAMLRELGVGCKMGFFLHVPMPSADLVQAMPDHARLFSTFYAYDLVGFQTQRDAERFKAYVRLFGGGRILEGDLVEGPGGRRFTASSFPIGIDTDLIAHQAKASAGKQAVRDLRESLRGRQLAIGVDRLDYSKGLPERFQGFERYLERYPDQSGSLTYLQIAPVSRGDVTEYRQLRSQLEQIAGHINGGHAEPDWTPLRYVNQNFSHATLTGFYRAASVCLVTPLRDGMNLVAKEFVAAQDPADPGVLVLSLFAGAADEMKEALLVNPHDLDGVADAIATAASMPLASRIERWHAMMDHLRKNNINHWRQRYLQALSEV

SEQ ID NO: 248 - protein, 520 aa, Trametes villosa
MSRFHSLLAFVVASLTAVAHAGIGPVADLTITNAAVSPDGFSRQAVVVNGGTPGPLITGNMGDRFQLNVIDNLTNHTMVKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVTTAVPGSPVAGGVDLAINMAFNFNGTNFFINGTSFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 249 - protein, 519 aa, Trametes villosa
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWAEGPAFVNQCPIASGHSFLYDFHVPDQAGTFWYHSHLSTQYCDGLRGPFVVYDPKDPHASRYDVDNESTVITLTDWYHTAARLGPKFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTPSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 250 - protein, 491 aa, Brassica oleracea
MVALTAEKQDQNLLSRMAAGDGHGEKSAYFDGWKAYEENPFHPIDRPDGVIQMGLAENQLCGDLMRKWVLEHPEASICTAEGVNQFSDIAIFQDYHGLPEFRQAVAKFMEKTRNNKVKFDPDRIVMSGGATGAHETVAFCLANPGDGFLVPTPYYPGFDRDLRWRTGVNLVPVTCHSSNGFKITAEALDAAYENARVSNIPVKGLLITNPSNPLGTTLDRDCLKSLVKFTNDKGIHLIADEIYAATTFGESEFISVAEVIDEIPDCNTDLIHIVYSLSKDMGLPGLRVGIVYSYNDRVVQIARKMSSFGLVSSQTQHLIAKMLSDEDFVDEFIRKSKLRLAERHAELTTGLDGLSIGWLKAGAGLFIWMDLRNLLKTATFDSEMELWRVIVHKVKLNVSPGGSCHCHEPGWFRVCFANMDYQTMETALERIRVFTSQTEEESLILTKPMAKKKKCWQSSLRLSFKDTRRFEEGFFSPHSPVPPSPLVRAQI

SEQ ID NO: 251 - protein, 473 aa, Trametes villosa
MSFSSLRRALVFLGACSSALASIGPVTELDIVNKVIAPDGVARDTVLAGGTFPGPLITGKKGDNFRINVVDKLVNQTMLTSTTIHWHGMFQHTTNWADGPAFVTQCPITTGDDFLYNFRVPDQTGTYWYHSHLALQYCDGLRGPLVIYDPHDPQAYLYDVDDESTVITLADWYHTPAPLLPPAATLINGLGRWPGNPTADLAVIEVQHGKRYRFRLVSTSCDPNYNFTIDGHTMTIIEADGQNTQPHQVDGLQIFAAQRYSFVLNANQAVNNYWIRANPNRANTTGFANGINSAILRYKGAPIKEPTTNQTTIRNFLWETDLHPLTDPRAPGLPFKGGVDHALNLNLTFNGSEFFINDAPFVPPTVPVLLQILNGTLDANDLLPPGSVYNLPPDSTIELSIPGGVTGGPHPFHLHGTDNPGPWFLHCHIDFHLQAGLAIVFAEDAQDTKLVNPVPEDWNKLCPTFDKAMNITV

SEQ ID NO: 252 - protein, 479 aa, Corynebacterium diphtheriae NCTC 13129
MSAIESNEGEQLFDFVVVANRLPVDLSTSADGSPRWVASPGGLVTALTPVLAGNRGCWVGWHGGTGPAPDPFRTDTNIWVHPVALSDHDFEGFYEGFSNATLWPLYHDLIVSPVYNRDWWTAYREVNLKFASAVAEVAAEGAVVWIQDYQLQLVPGILRQIRPDLTIGFFLHIPFPHSDLFRQLPWREEIVRGLLGADLVGFHLTSSANNFLDLAAALGLEAQGRAKVREVSATVTAGDGHVVSVAAYPISIDVEPLIASHSNRDEIRAEFGYPETLILGVDRLDYTKGILQRLLAFEELLESGAIDPNTTVFAQVATPSRERIEHYKQARSEVEEAVGRINGRFGSIGRSVVHYHHRHMDRSELNKLYRAADVMLVTPFKDGMNLVAKEYVSCHSDGSGAMVLSEFAGAAVELEQAFLCNPFDLESIKRQIAGAVTTLKNHPEAARDRMLAMHQQVVDHDVNVWASAFLRDLSSAHTS

SEQ ID NO: 253 - protein, 520 aa, Trametes villosa
MGRFSSLCALTAVIHSFGRVSAAIGPVTDLTISNGDVSPDGFTRAAVLANGVFPGPLITGNKGDNFQINVIDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPIGSDSTLINGLGRFAGGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVPLDSPAAPGDPNIGGVDYALNLDFNFDGTNFFINDVSFVSPTVPVLLQILSGTTSAADLLPSGSLFAVPSNSTIEISFPITATNAPGAPHPFHLHGHTFSIVRTAGSTDTNFVNPVRRDVVNTGTVGDNVTIRFTTDNPGPWFLHCHIDFHLEAGFAIVFSEDTADVSNTTTPSTAWEDLCPTYNALDSSDL

SEQ ID NO: 254 - protein, 165 aa, Helicobacter hepaticus ATCC 51449
MKKIGLFYGSDGGTTQEVAQKIADKLGDCQIFDVASSKADDLSAFENLIFATPTYGSGDLQDDWDSFLSSIDEAAFSGKTIALVGLGDQEIYSETFCNGIAHIYEKVSKQGKIIGQTSTDGYTFDESLAVVNGKFVGLVIDEVNQEDMTDSRIQAWVKTLKGAFA

SEQ ID NO: 255 - protein, 519 aa, Ceriporiopsis subvermispora
MARFQTLSAAVALGLSLGAFAAIGPVTDLEITDAFVSPDGPGLGREAVLAGGTFPGPLIQGNKGDNFQINVVNNLTNHTMLKTTSIHWHGLFQHGTTWADGPAFVSQCPIASGNSFLYNFNVPDQAGTFWYHSHLATQYCDGLRGPLVVYDPNDPHADLYDVDDESTVITLSDWYHAAASTLTFPTFDTTLINGLGRFAGTGGSDSNLTVITVEQGKRYRFRLVSISCDPNWVFSIDQHELTVIEVDGVNAVPLTVDAIQIFAAQRYSFVLNANQTVDNYWIRANPNNGNMGFANGINSAILRYVGADDVEPTSTGTTANLLNEADLSPLVPAAAPGAPNQDFDAVDVPMNLNFTFNGTNLFINGATFVPPSVPVLTQILSGAMTAQELLPAGSVYTLPRNATVQLSLPGNIIAGPHPFHLHGHTFSVIRSAGQSDYNYVDPIQRDVVSIGGATDNVTIRFTTDNPGPWFFHCHIDWHLQAGFAIVFAEETADVASANPVPADWSALCPTYDALSDADH

SEQ ID NO: 256 - protein, 485 aa, Corynebacterium glutamicum
MDDSNSFVVVANRLPVDMTVHPDGSYSISPSPGGLVTGLSPVLEQHRGCWVGWPGTVDVAPEPFRTDTGVLLHPVVLTASDYEGFYEGFSNATLWPLFHDLIVTPVYNTDWWHAFREVNLKFAEAVSQVAAHGATVWVQDYQLLLVPGILRQMRPDLKIGFFLHIPFPSPDLSRQLPWREEIVRGMLGADLVGFHLLQNAENFLALTQQVAGTAGSHVGQPDTLQVSGEALVREIGAHVETADGRRVSVGAFPISIDVEMFGEASKSAVLDLLKTLDEPETVFLGVDRLDYTKGILQRLLAFEELLESGALEADKAVLLQVATPSRERIDHYRVSRSQVEEAVGRINGRFGRMGRPVVHYLHRSLSKNDLQVLYTAADVMLVTPFKDGMNLVAKEFVANHRDGTGALVLSEFAGAATELTGAILCNPFDVESIKRQMVAAVHDLKHNPESAATRMKTNSEQVYTHDVNVWANSFLDCLAQSGENS

SEQ ID NO: 257 - protein, 456 aa, Oceanicola granulosus HTCC2516
MSQQGRLIVVSNRIPTEAAPSGGLVVALHEALESRGGIWIGSSGQVVDEPGGLKTLADDKYTRLAFDLTKAEHEGFYLGYANSVLWPLFHHRADLIDVDQGDRDQYMGVNARVAQLIAEVIEPNDVLWIHDYHFLPLAAELRKLGLDNRMGYFLHIPFPNPSDIAALPDRKQLPHWIAAYDLIGLQTQRDVSACLEWLRGDTAAEFTLRGRMKLDTRHFEVRSFPIGIDVDAFRDAAERADITITDLPTNQKLILGVDRLDYSKGLPNRFEAFGKYLSMRDKNLPHATMIQVAPPSREDVEAYKDIRVQLESMAGSVNGEHAELDWTPIRYLRRPLPRDVVAGLYRRADVCLVTPLADGMNLVAKEYVAAQDGADPGVLILSHFAGAAEQLDGALMVNPYDTVSMAEAIDQALKMDLHERRARWLSMMQVIRETDIDWWTNSFLRSLQNQPQMRVA

SEQ ID NO: 258 - protein, 623 aa, Melanocarpus albomyces
MKTFTSALALVVGMLAPGAVVAAPPSTPAQRDLVELREARQEGGKDLRPREPTCNTPSNRACWSDGFDINTDYEVSTPDTGVTQSYVFNLTEVDNWMGPDGVVKEKVMLINGNIMGPNIVANWGDTVEVTVINNLVTNGTSIHWHGIHQKDTNLHDGANGVTECPIPPKGGQRTYRWRARQYGTSWYHSHFSAQYGNGVVGTIQINGPASLPYDIDLGVFPITDYYYRAADDLVHFTQNNAPPFSDNVLINGTAVNPNTGEGQYANVTLTPGKRHRLRILNTSTENHFQVSLVNHTMTVIAADMVPVNAMTVDSLFLAVGQRYDVVIDASRAPDNYWFNVTFGGQAACGGSLNPHPAAIFHYAGAPGGLPTDEGTPPVDHQCLDTLDVRPVVPRSVPVNSFVKRPDNTLPVALDLTGTPLFVWKVNGSDINVDWGKPIIDYILTGNTSYPVSDNIVQVDAVDQWTYWLIENDPEGPFSLPHPMHLHGHDFLVLGRSPDVPAASQQRFVFDPAVDLARLNGDNPPRRDTTMLPAGGWLLLAFRTDNPGAWLFHCHIAWHVSGGLSVDFLERPADLRQRISQEDEDDFNRVCDEWRAYWPTNPYPKIDSGLKRRRWVEESEWLVR

SEQ ID NO: 259 - protein, 467 aa, Azotobacter vinelandii
MSRLVVISNRVAPIREGKIAAGGLAVGVYDALRQNGGIWFGWNGEVGQKPETACESAGNITYVTLGLSKPDYNEYYRGFSNATLWPIFHYRIDLARYSREEYLGYRRVNAMLAEKLKPLLRPDDILWVHDYHLIPFAAACRQLGIGNRIGFFLHIPFPTTEVLTAVPPHRDLFQTLCDYDLVGFQTESDRMAFQDYVCRELDGLIGTDGSLTACGRNFRAGVYPIGVMPDDIRRLADSYRGRRPMIGRTAEGKLRKTLISVDRLDYSKGLVERFLAYEQFLEHYPEHRRNVELIQIAPTSRTDVKTYRAIRKQLETVAGHVNGRLADLDWMPLHYLNKSLERRTLMGLFRTANVGLVTPLRDGMNLVAKEYVAAQNPADPGVLVLSRFAGAAHELGAALIVNPYDCLGMAEAMDRALRMPLEERKERYEDMMRALRAADLNAWRDNFLRDLRTFGRHRVVTASRAAV

SEQ ID NO: 260 - protein, 173 aa, Photobacterium sp. SKA34
MKIGLFYGSTTCYTEMAAEKIRDCIGTELIELHNIKESDINEMNQFDMLILGISTWDFGELQEDWEAVWQQLDGLRLTNKTIALFGLGDQEGYTEWFLDAMGMLHDKLLEANVQFIGYWPNDDSYQFEASKALTDDKQFFVGLALDEDGQYELSDQRITQWCEQIMLEYAETL

SEQ ID NO: 261 - protein, 554 aa, Oryza sativa Japonica Group
MASAAMLVPLVLVLCTAAASAAVVEHTFKVGGTKITQLCMNSVIYTANQQLPGPTIEVTEGDTLVVHAVNDSPYPLSLHWHGVYQLRSGWNDGANKITQCPIQPSGNFTYRFNITGQEGTLWWHAHSSLLRATIYGALIIKPRNGPSGYPFPEPYEEIPILLGEWWNRNVDDVENDGYLTGLGPQISDALTINGMPGDQNRCKGSAMYEVEVEYGKTCLLRIINAAVNVELFFKVAGHTFTVVAADASYTKPYATDVIVIAPGQTVDALMNTTASPGRYYMAAHVFDSKTVAVPFDQSTATGIVKYKGVPNYAPAAMPSLPPHDDVVTAGRFYWSLTGLARPSDPGVPTTVDHNMVVTFGLDQAPCAPNQTKCSGFALVAAMNRNSFQFPDQKVSLLEALYKGVPGVYSEDFPDFPPPMQGFRKATAVKKVKYNDVVEVVLQSEQYSSTLGTENHPIHLHGFDFYLLAQGLGRFNPSMKSKYNLVDPQVRNTVAVPAGGWAVIRFMANNPGMWFMHCHLDAHLPLGLAMVFEVLNGPAPNLLPPPPVDHPKCHG

SEQ ID NO: 262 - protein, 482 aa, Nocardioides sp. JS614
MKNVASSGSADLVIVANRLPVDRVPLGDGTAEWRRSPGGLVTAIEPVMRANDGSWIGWPGGTESDLEPFEDEGLDLVPITLTQQEVEEFYEGFANGTLWPLYHDVAAKPEFHREWWDAYVVVNRRFAEQAAAAASEGATVWVHDYQLQLVPQMLRELRPDLRIGFYLHIPFPPTELFQQLPWRRQLLEGLLGADLVGFQLPGAAQNFVRLVRQRVGHKTHRDLVYLPDGRTVRAAAFPISIDAKGFEDLARSEEVEKRAAEIRDALGNPSRIFLGVDRLDYTKGIYARLRAYSELLAQGDLDVEDAVFVQVATPSREQVEQYRILRDDIDRLVGRINGDLGRIGRPAISYMHASYPREEMAALYRAADIMVVTPYRDGMNLVAKEYVACRFDNDGALVLSEFAGAADELRQAWLVNPYDINGMKSALLEAYRADEKERTRRMKAMRKTVSQNDVAAWADSFLAELTAVRPSHGKTVRPARRS

SEQ ID NO: 263 - protein, 461 aa, Burkholderia cenocepacia J2315
MSRLIIVSNRVAPISEGEPAAGGLAIGVYDALKETGGMWFGWSGEVVASGAPQPQIRIEERGPVTFATVGLSRRDYDQYYRGFSNATLWPAFHYRADLIQYDRHEFDGYRRVNVWLAQQLVPLLQDDDVIWVHDYHLIPFARALRDAGVKNRIGFFLHIPFPAAQVLVNVPPHRELVESLCAFDLLGFQTEPDLRAFCDYVEFEADGDVERDGHTVHVRAFGQTLRAAAYPIGVYPDEIASLAQAGEHGKAVRTLATSLRGRQLIMSVDRLDYSKGLVERFRAFEKLLEHQASIRNRVSFLQIAPSTRADLRAYQDIRLQLEAESGRINGRYAELDWAPILYIHRQYDRQVLAALYRLARVGFVTPLRDGMNLVAKEYVSAQNPDDPGVLVLSRFAGAARELTGALIVNPIDIDGMADALSQALTMPLAERRARYADMIAQLRENNVSVWRDNFLRDLQHV

SEQ ID NO: 264 - protein, 181 aa, Blastopirellula marina DSM 3645
MSVSIAIFYGSTTGNTEMAANKIAEELGGLLTHIGDVSQTKPAELTQYDVLLLGVSTWNIGEMQDDWFDFLRKLGDLDLTGKKVGLFAMGDSYGYPDNFLDAMGELWEAIQKRGAALVGVWPAAGYQFDESQAMYDDEHFVGLGLDEDNESDQTEDRIRGWLVQVLQEIGLLDLQDLADAG

SEQ ID NO: 265 - protein, 171 aa, Salmonella enterica subsp. enterica serovar Paratyphi B str.
MGLFYGSSTCYTEMAAEKIRDILGPELVTLHNLKDDAPALMEQYDVLILGIPTWDFGEIQEDWEAVWEQLDDLNLEGKIVALYGMGDQLGYGEWFLDALGMLHDKLAPKGVKFVGYWPTEGYEFTSNKPVIADGQLFVGLALDETNQYDLSDERIQTWCEQILGEMAEHYA

SEQ ID NO: 266 - protein, 528 aa, Salinibacter ruber DSM 13855
MRRGSNEETTERRIRQGTSTAAEQHPPRALPSFVRTGMLVALIVRGAHARLDRRPGRAGPGPNHCFFDHAAPIALSLTVVANRVPIRQTDDGWETSVGGLTTALLPVLEEEGGMWVGMGEDPDLPERQEYPADDPDFLVRRVPLSSKELEGYYYGMANQILWPLSHYLIQHLNLDDQFIETYRQVNERFAEAVLAETETGDEDVIWIQDYHQMLSPNLIRQERPDATIGHFWHIPWPAMEIFRILPWSRELLRGMLGCDLIGFHVQEYVDNFIESAEVLLGAEVDGDRVRHNGHETRVEAHPIGIDVDRFKEMSRDDSIEQDAQKFRERLGSDHIVIGIDRLDYTKGIRSRMLAFEKFLEENPEYHGNVSFFQIATPSRTELESYQQIRREVDEVVGRINGRFAEENWVPVNYRYRTYTQYELCAFYRAADAALITPLRDGMNVVTQEFVTASQDGVLILSELTGAAYLLPEAVQVNPYDHGGVADAIRTALEMPTGEREERLAGLKDTIETLDVHNWAGNFLDSIQE

SEQ ID NO: 267 - protein, 177 aa, Vibrio vulnificus YJ016
MASVGIFFGSDTGNTEAVAKMIQKQLGKKLVHVQDIAKSSKEDIDNFDLLLLGIPTWYYGEAQCDWDDFFPELEKIDFSTKLVAIFGCGDQEDYAEYFCDAMGTVRDIVEAKGGTILGHTSTESYEFEASKALVAGDDSLFVGLCIDEDRQPELTEERVKNWVEQIYEEMCLAELED

SEQ ID NO: 268 - protein, 573 aa, Rosa hybrid cultivar
MKILISLQLLLGLLLAINGILLHCQAWPARYTFVVEETPYKRLCSTKNILTVNGQFPGPTLYARKGDTVIVDVFNRGNRNITLHWHGVDQPRNPWSDGPEYITQCPIQPGANFTQKIIFSEEEGTLWWHAHSEWDRATVHGAIIIYPNKDNNYPFAKPHAEIPIILGEWWKEDIGKLYTQTFQSGGDPNNSSAFLINGQPGHLYPCSESETFNLMVDYGKTYLLRLINSAVQEIMFFSIANHKVTVVGADASYTKPFTTDYVTISPGQTLDLLLTANQKPNHYYMAAKAYVGGVGVPYDNTTTTALLQYSNRGLKNYTYTPSRTPSFPTLPAYNDTNASVNFSGSLRSLADKNHPIDVPLKITTHLFYTVSVNSFPCPNNSCAGPNGTRFAASVNNISFVDPSIDILQAYYYHVNGEFGTRFPDFPPSLFNFTAQDLPLYLQIPKRGTEVKVLEYNTTVELVLQGTNLVSGDDHPMHLHGYSFYVVGMGLGNFDKDKDPLKYNLVDPPLRNTVIVPVNGWTTIRFKANNPGVWFMHCHLDRHMSWGMDVTFIVKDGKGPQAQMLPPPPDMPPC

SEQ ID NO: 269 - protein, 808 aa, Physcomitrella patens subsp. patens
MSEGSRMLVVARMLPLNAVPHPNGNSYLFEWDKDSLLWQLRDGLRPGMEVIYVGCLKVEVEDADQDEIAAMLLENFNCVPAFLPNELKSRFYHGFCKQMLWPLFHYLLPLSPEHGGRFKRSWWQAYVSVNKIFADKVMEVISPDDDYVWVHDYHLMVLPTFLRKRFNKVRLGFFLHSPFPSSEIYRTLPVRDEILRALLNADLIGFHTFDYARHFLSCCSRMLGLEYASKRGHIGLEYYGRTVGIKIMPVGIHMGQFDASLKLADTKWRIGEIREKYKGMSVLLGVDDMDIFKGIGLKFLAMEELLRQHPQWQGKVVMIQIANPARGSGKDIDEAREEAYTIAKKVNEEFGNERYTPIVLEERHVPLFERIAYYTIAECCVVTAVRDGLNLIPYEYIVCREGAPQMSESENYLEESSVKKSMLIVSEFIGCSPSLSGAIRVNPWNIEMVAEAMNSAITMKEQEQHLRHEKHYRYVSTHDVAYWAKTYTSDLERTCRDHNKRRCYGIGFGLGFRIVALDPSFKKLRTELIVGAYGKSATRALLLDYDGTVMPTSHEESPSPEVLDLLNTLCNDPKNTLFIVSGRPRNKLGEWFSSCELLGLAAEHGYFYRYKWDRLSVVEREAPSTSFDWKLIAGPVMQLYTESTDGSYIEAKESALVWHYRDADHDFGAWQAKELQDHLESVLANEPVTVKSGAQIVEVTPQGVSKGIMVEKLLLMMEKKNGALPDMVLCVGDDRSDEDMFESIESLMRGAPSAEVFACTVGQKPSKAKYYLDDVGEVIKMLQGLANASIRSSASSLPQLSDFSSLHI

SEQ ID NO: 270 - protein, 483 aa, Oryza sativa
MAAPSVAVDNLNPKVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 271 - protein, 75 aa, Arabidopsis thaliana
  misc_feature (27)..(27): Xaa can be any naturally occurring amino acid
  misc_feature (42)..(42): Xaa can be any naturally occurring amino acid
QAGKGPNGISCLKLLEATGISTVPGSXLGQKERVFHLRTTIXPAEDEMPEIIDTVKKLPRRIMTQYDNNCGYSKK

SEQ ID NO: 272 - protein, 462 aa, Streptomyces coelicolor A3(2)
MASSFGAAQVLVASNRGPVSYEVREDGSLHAKRGGGGLVSGLSAIGPDAGALWVCSALSDGDREAVRRGVGEDGVRMLDVPADVHADAYNGIANSVLWFVHHMLYQTPLEPVFDAEFRRQWASYEAYNRAFAEALAEEAAEGAVAIVQDYHLTLVPGMLRELRPDLRIGHFSHTPWAPLDYFRLLPDDIAEQVLRGMLGADRLGFLTRRWADAFTACCDAVVGGLGGTEIGVHGLGADGDFLRKRSHEADVEERMAELREQIGEGRRTIVRVDRTELSKNIVRGLLAYRELLAGRPEWRERVVHVAFAYPSRQDLAVYREYTAEVERVANAVNEEFGTPGWTPVVLNLKDDFARSLAAYRLADVALVNPVRDGMNLVAKEVPVVSDTGCALVLSREAGAYEELGEDAVVVNPYDVVGTADALHAALGLPAGDRAERSKRLAAAGTALPPARWFLEQLEALRG

SEQ ID NO: 273 - protein, 404 aa, Salmonella enterica subsp. arizonae serovar 62:z4,z23:--
MSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVNIAREHNLIIFADEIYDKILYEDAEHHSIAALAPDLLTITFNGLSKTYRVAGFRQGWMVLNGPKKHAKGYIEGLDMLASMRLCANVPAQHAIQTALGGYQSISEFILPGGRLYEQRNRAWELINDIPGVSCVKPRGALYMFPKIDAKRFNIHDDQKMVLDFLLQEKVLLVQGTAFNWPWPDHFRIVTLPREDDLEMAINRFGRFLSGYHQ

SEQ ID NO: 274 - protein, 552 aa, Cucurbita pepo var. melopepo
SQIRHYKWEVEYMFWAPNCNENIVMGINGQFPGPTIRANAGDSVVVELTNKLHTEGVVIHWHGILQRGTPWADGTASISQCAINPGETFFYNFTVDNPGTFFYHGHLGMQRSAGLYGSLIVDPPQGKKEPFHYDGEINLLLSDWWHQSIHKQEVGLSSKPIRWIGEPQTILLNGRGQFDCSIAAKYDSNLEPCKLKGSESCAPYIFHVSPKKTYRIRIASTTALAALNFAIGNHQLLVVEADGNYVQPFYTSDIDIYSGESYSVLITTDQNPSENYWVSVGTRARHPNTPPGLTLLNYLPNSVSKLPTSPPPQTPAWDDFDRSKNFTYRITAAMGSPKPPVKFNRRIFLLNTQNVINGYVKWAINDVSLALPPTPYLGAMKYNLLHAFDQNPPPEVFPEDYDIDTPPTNEKTRIGNGVYQFKIGEVVDVILQNANMMKENLSETHPWHLHGHDFWVLGYGDGKFSAEEESSLNLKNPPLRNTVVIFPYGWTAIRFVADNPGVWAFHCHIEPHLHMGMGVVFAEGVEKVGRIPTKALACGGTAKSLINNPKNP

SEQ ID NO: 275 - protein, 428 aa, Mycobacterium sp. MCS
MDDVTMPQTPAERTWHPQGHQPRPRTFTQSSKLQDVLYEIRGPVHEHASRLEAEGHRILKLNIGNPAPFGFEAPDVIMRDIIQALPYAQGYSDSKGIMPARRAVFTRYELVDGFPRFDVDDVFLGNGASELIQMVLQALLDNGDQVLIPAPDYPLWTACTSLAGGTPVHYLCDETQGWNPDVADIESKITDRTKAIVVINPNNPTGAVYSRETLERIADLARKHQLLLLADEIYDKILYDDAKHISLASVAPDVLTLTFNGLSKAYRVAGYRSGWLVITGPKEHASSFIEGISLLANMRLCPNVPAQHAIQVALGGHQSIDDLVLPGGRLLEQRDVAWEKLNEIPGVSCVKPAGALYAFPRLDPEVYEIHDDELLVLDLLLQEKILVVQGTGFNWPTPDHLRIVTLPWARDLANAIERLGNFLVSYRQ

SEQ ID NO: 276 - protein, 900 aa, Zygosaccharomyces rouxii
MVNSGHRRQRIINCVAQLPYKIQLGETNDEWNIVPATGSSSLYSSIEYLNSEEKAKDYEQHVLGWTGEIGRESLPSRLFNSKNRDKSENGEKGENDLHAKEEREKEEDPLYLTNDQIDGITKDLRRHGKSDDHYNVDNVHPVWLLRRDQKRWRGFAENVLWPTFHYILKFSSDSGEKENLSWYDYVRFNEAYAMKIGEIYEKGDIIWIHDYYLLLLPQLLRMKFNDQDLTIAYFHHSPWPSNEYFRVLPRRKQILDGLMGADRGWFQNEGFARHFVSSCKRLLDSTSRKSKNRLGMEQYQISAYGGDIVVDSLPIGINRVKLLEDTFTKDIAQKVLAIKDAFQGKKIIVGRDRLDSVRGVVQKLRAFETFLSMYPEWRDQVVLIQVSVPSMKGGTNQLIRLEQQVNELVTSINMQYGSLNFSPVHHYYMRIPKDVYLSLLRVADLCVIASVRDGTNTTALEYVTVKSHMSNYNCYGNPLILSEFSGTSTILKDAMIINPWDSVAVAKSINRALSLSRDEKRALEDKIWPQVPTIQKWTDQFLSTLSDIVDEAHNTTDRKMTPALNRPALLEHYRQSKRRLFLFDYDGTLTPIVQDPAAAIPSARLISILQKLASDPCNQIWIISGRDQAFLNKWLGSRLPQLGLSAEHGCFYKDVDEENWINLTEKFDMSWQEKVGSIMEEFTRRTPGSFIERKKVALTWHYRRADPELGEFYASELKKELDKICADYDLDVMEGKANIEVRPKFVNKGEIVKRLVWHHHGRRQDMLNTKKEELPISEMPDFTLCLGDDFTDEDMFNQLNDIEAVWKKQYEDEVNQWGGFGLYPCTVGSASKKTVAKAHLTDPQQVLDTLGLLVGDVSLFQSAGTVELDSRGHVKHSDSSIRSEQASARYAMKRQQSYKN

SEQ ID NO: 277 - protein, 624 aa, Cryptococcus neoformans var. grubii
MRGVVKLFFLSCSLVSLVSSEETGKSPTANYDHYMPKATATIDPSVFALSNDFEITDVPTTREYTFDITKALASPDGYEREVYVVNNMFPGPVIEANTGDTIIVHVNNHLEEGQSIHWHGLRQLGTAFMDGVPGITQCPIPPGSSFTYQFTVSHQSGTFWWHSHYSNSMADGIWGPLIVHSPNEPLQRGRDYDEDRIVFITDWVHDNSEVVIAALATPEGYKGSPAPPQGDAILINGRGQTNCTATGSSSCTYPPPPEIHVPVNCRVRLRFISATAHPMYRITIDNHPLEVVETDGTAVYGPTVHEISIAPGERYSAIINTSEGKEGDAFWLRTSVALGCMFGGIDQVGLAVVRYTGNGMVSTEEPQTTAWSDLAGATTPCAGLDQTYTLSPRESFSAPREFSQSHVFNSQRGAFVNVYGNTFQGYGFNNISYQNQIFNPLLSIVQRGGSCESTLVASTTFPDLGSGNIIINNLDGVIDHPYHLHGNEFQVIGRGTGALSLDNLTNIDFNLDNPVRKDTLWIQGGSWVVLRITTDNPGVWALHCHIGWHLTEGKLAVVVIQPGAIGHMEGPESWTNLCANTDPNAFGPARRSPSPSIQSSKTSIFQYLREVKGKVVKRRGAREA

SEQ ID NO: 278 - protein, 364 aa, Triticum aestivum
  misc_feature (41)..(41): Xaa can be any naturally occurring amino acid
  misc_feature (153)..(153): Xaa can be any naturally occurring amino acid
  misc_feature (175)..(175): Xaa can be any naturally occurring amino acid
  misc_feature (198)..(198): Xaa can be any naturally occurring amino acid
  misc_feature (241)..(241): Xaa can be any naturally occurring amino acid
  misc_feature (273)..(274): Xaa can be any naturally occurring amino acid
  misc_feature (288)..(288): Xaa can be any naturally occurring amino acid
  misc_feature (301)..(301): Xaa can be any naturally occurring amino acid
  misc_feature (311)..(311): Xaa can be any naturally occurring amino acid
  misc_feature (318)..(318): Xaa can be any naturally occurring amino acid
WIPRAAGIRAREQPVTFFREVLALCDHPDLLKKEEIKTLFXARAPPRAKQILALIPGRATGAYSHSQGIKGLRDAIASGIASRDGFPANADDIFLTDGASPGVHLMMQLLIRNEKDGILVPIPQYPLYSASIALHGGSLVPYYLNESTGWGLXEISDVKKQLEDARSRGIDVRAXLVGINPGNPTGQVLAEENQYDIXVKFCKNEGLVLLADEVYQENIYADNKKFHSFKKIVRSLGYGEXEDLPLVSYQSVSKGYYGECGKRGWVTWMVTWXXLAFSAPVREQIYKXASVNLCSNITGHXLASLVMNPPXLSDESYXASYKAEKRWDSLSLASSVPKGIGAGCIHLLGITCTVQSNVLPAAQP

SEQ ID NO: 279 - protein, 170 aa, Wigglesworthia glossinidia endosymbiont of Glossina brevipalpis
MKSIGMFFGSDTGNTERIAKKIQKKIGINNIDIFDISNSSKEEMEKYKKLIFGIPTWYYGELQCDWDDFLIYLKEINFENKLVAIFGCGDQEDYSEYFCDAMGIVKEIISYKGAKVIGKYSTLGYKFEKSKALLNKDYFIGLAIDEDRQPELTEKRICNWVKTIKKEMEI

SEQ ID NO: 280 - protein, 284 aa, Oryza sativa Japonica Group
MTNTNQPTGKTGRPYSGNGFGIILDEQQQYELVKFCKDEELVLLADEVYQENIYVTNKKINSFKKIARSMGYNGDDLQLVSLHSVSKGYYGECGKRGGYMEVTGFSTPVREQLYKIASVNLCSNITGQILASLIMDPPKAGDASYDLYEEEKDNILKSLSRRAKAMESAFNSIDGITCNKTEGAMYLFPRIYLPQKAIEAARAVNKAPDVFYALRLLDTTGIVVTPGSGFGQIIRCYLFTCNSEFLTTQVWSFVKGCRDMAREMHDPAAGGEDTFDDLPLQGIP

SEQ ID NO: 281 - protein, 644 aa, Oryza sativa Japonica Group
MATGVSVENINPKVILGPSSIAECIVIRGEVAIHAQVSWFSPSMFWKSISIYSFSANARREINRYLTFFFQHLQQQLQTQPGSLPFDEIVYCNIGNPQSLGQKPITFFREVLALCNHPNLLEREEIKSLFSTDAIARAKKILSMIPGRATGAYSHSQGIKGLRDEIAAGIASRDGFPANADDIFLTNGASPGVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEFTTQHPKAKEKQQPKMCGGAILAELIPSAPAARRVTAGHVWPGDANKAKKKGARADDFEAAFRDFDNDSDDEEMMVEEAEEEEATSEHKPFVFRAKKAAAAASSRRRKPAQYRGVRRRPWGKWAAEIRDPVKGIRVWLGTFTNAEAAALAYDDAARAIRGDRAKLNFPSATTPDTRKRGRATAAAAPAVKATPVINLVEEEDEEEVAAAMASIKYEPETSESSESNALPDFSWQGMSASDEFAVAAAALSLDSDDDLAKKRPRTEPEDTTDSGSGDDTDALFDALLFADQYNHFNGGAYESLDSLFSADAVQTTAAAAAADQGMGLWSFDDGCCLVDVEASLSF

SEQ ID NO: 282 - protein, 405 aa, Escherichia coli O157:H7 EDL933
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPCGALYMFPKIDAKRFNIHDDQKMVLDFLLQEKVLLVQGTAFNWPWPDHFRIVTLPRVDDIELSLSKFARFLSGYHQL

SEQ ID NO: 283 - protein, 133 aa, Brassica napus
SVRNPLSPDLGGRFDRSLWQAYVSVNKIFADRIMEVINPEDDFVWIHDYHLMVLPTFLRKRFNRVKLGFFLHSPFPSSDIYRTLPIIEELLRALLNADLIGFHTFDYARHFLSCCSRMLGLTYESKRGYIGLE

SEQ ID NO: 284 - protein, 477 aa, Oryza sativa
MSYNHSPSITAETINQKVRIFTYEPCGEIVRHARIIYCNLGNPQALGQRPINFFREVLSLCDNPSLIDRDEARALFSPCALKRARKIIESLPGRDSGSYTSSQGVRGLREAVADGIAARDGFPSKPDNIFLTDGASSAINMMMQILIRSHEDGILCPLPEYPLYSASIILHGGTMVPYNLTEDSIWGLEIFEVKRCLEDARASGLTIRAMVVINPGNPTGQVLSITNQEEIVEFCRKEGLVILADEVYQENVYTENKRFNSFKKVARSLGYDHHDLSIVSFHSVSMGYYGECGRRGGYMEICGFGDDVIDEMYKLASLTICPNIAGQILISLVMDPPKLGDEAFEIFMVEKEETYSSLLKRAKALQKAFNGLEGVSCNKFEGAMYLFPRLRLPQAAIKAAQLEGVSPDVFYAHRLLDATGIAVVPGSGFHPDLVSSCKKVSGTSHIRCTILPGEETITAMVPSLQAFHEAFMDEFRG

SEQ ID NO: 285 - protein, 532 aa, Arabidopsis thaliana
AKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILSPIPQYPLYSASIALHGGSLVPYYLDEATGWGLEISDLEKQLEEARSKGISVRALVVINPGNPTGQVLAEENQRDIVNFCKQEGLVLLADEVYQENVYVPDKKFHSFKKVARSLGYGEKDISLVSFQSVSKGYYGECGKRGGYMEVTGFTSDVREQIYKMASVNLCSNISGQILASLVMSPPKPGDDSYDSYMAERDGILSSMAKRAKTLEDALNSLEGVTCNRAEGAMYLFPRINLPQKAIEAAEAEKTAPDAFYCKRLLNATGVVVVPGSGFGQVPGTWHFRCTILPQEDKIPAIVNRLTEFHKSFMDEFRN

SEQ ID NO: 286 - protein, 886 aa, Gibberella zeae PH-1
MAANSENNGSEPTLRRRESLSEIRAANPDLALSGNIISATFNTPHSFVYRKGGDWDLKSRRGQSALFDSFAYLSSDATPWNHTVVAWTGEIDAPTDDVVSLPGTPAPNTLGATSLNALSAPVPIDGNTRLPTPPPVDGLWVPREDQDRLEYRLSHNKTIRTYPVWLSDESEATSEGILLKDQARWRRYAEHDLYTLLHYKQHEPTDGRRERVQWADYYRMNQKFANKIIEIYKPGDIVIVHDYFLMLLPSMLRQRVPNMYISFFLHSPFPSSEFLRCLPRRKEVLEGVLGSNLIGFQSYSYSRHFLSCCTRILGFPSDTLGIDAYGTRVQVGVFPIGIDAAKVENFAWTDAVTEKCNALRQLYRGKKIIVGRDRLDSVRGVAQKLQAFERFLEMYPEWREKVVLIQVTSPTSVEAEKEDLEDDTKVATRVNELVMRINGMYGSLGFSPVQYYPQYLSQNEYFALLRASDMGLITSVRDGMNTTSLEYIICQKVGNAPLILSEFSGTASSLGDAIHINPWDLSGVAEKINAALTMSDDKRQEMQSRLYRHVTEHNVQSWITKFIRKVYNVLGDTSSANSTPLLDRALLLTQYRSANKRLFMFDYDGTLTPIVREPSAAVPSQRLIHTLDLLAADPKNAVWIISGRDQEFLKQHLGNNTRLGFSAEHGSFMKHPGSDEWENLAETFDMGWQAEVMEVFQKYTDRVQGSFIERKRCALTWHYRLADPEQGIHMSRECHKELESTVASKWDVEVMPGKANIEVRPTFINKGEIAKRLITMYHTPGTADDNDGNGHLEFALCMGDDFTDEDMFRSLNAASGPVLDANHVFTVTIGASTKVTLAKSHLLEPEDVIECVALLAGVQDQGERLGEVNLGALSAVEGHVPEQQEM

SEQ ID NO: 287 - protein, 821 aa, Arabidopsis thaliana; identical to SEQ ID NO: 195

SEQ ID NO: 288 - protein, 508 aa, Oryza sativa Japonica Group
MATGVSVENINPKVILGPSSIAECIVTNARREINRYLTFFFQHLQQQLQTQPGSLPFDEIVYCNIGNPQSLGQKPITFFREVLALCNHPNLLEREEIKSLFSTDAIARAKKILSMIPGRATGAYSHSQGIKGLRDEIAAGIASRDGFPANADDIFLTNGASPGVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEVYQENIYVTNKKINSFKKIARSMGYNGDDLQLVSLHSVSKGYYGECGKRGGYMEVTGFSTPVREQLYKIASVNLCSNITGQILASLIMDPPKAGDASYDLYEEEKDNILKSLSRRAKAMESAFNSIDGITCNKTEGAMYLFPRIYLPQKAIEAARAVNKAPDVFYALRLLDTTGIVVTPGSGFGQIIRCYLFTCNSEFLTTQVWSFVKGCRDMAREMHDPAAGGEDTFDDLPLQGIP

SEQ ID NO: 289 - protein, 404 aa, Yersinia pestis CO92
MSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 290 - protein, 174 aa, Haemophilus parasuis
MAVVGLFYGSDTGNTENISKMIQKQLGANLVDIRDIAKSTKEDIEAYDFLLIGIPTWYYGESQADWDDFMPTLKEIDFTGKIVGIFGCGDQEDYAEYFCDAMGTVRDVIEPNGGTIVGHWSTEGYTFEPSQALVDDETFVGLCIDEDRQPELTEERVNRWCKQIFDEMYLAELA

SEQ ID NO: 291 - protein, 194 aa, Saccharophagus degradans 2-40
MAITAFGSIGEAAVAAKIGLIYGSDDGNTETIAFRIQARLGEENVDVLDVSDVTQMDFASYDKLILGIPTWDFGQIQSDWEDFWDDVKEVGFEGKTVALFGLGDQFGYGDFFLDAMGMLHDVIVENGAKIVGHWPVEGYEFDASKALIEGEGLFVGLGIDEDQQPELSASRLNKWVSQISHEFNLGYEPIELDD

SEQ ID NO: 292 - protein, 520 aa, Trametes sp. I-62
MAKLQFSNFFVTLAVVTGALAAVGPKADLTITNAVVAPDGFSRDAVVVNGVFPGPLITGKKGDRFQLNVIDNLTNHTMLKSTSIHWHGFFQAGTNWADGPAFVNQCPISTGHAFLYDFHVPDQAGTFWYHSHLSTQYCDGLRGPIVVYDPLDPHAFRYDVDDESTVITLSDWYHTAARLGPRFPLGADATLINGLGRSSSTPTANVTVINVQHGKRYRFRLVSLSCDPNHTFSIDGHNLTVIEVDGVNSKPLTVDSIQIFAAQRYSFVLNANQTVGNYWIRANPNFGTTGFAGGINSAILRYQGAPIIEPTTVQTTSVIPLVETNLHPLVPTIVPGLPVSGGVDKAINLAFNFNGTNFFINNATFTPPTVPVLLQILSGASTAQDLLPPGSVYPLPAHSSIEITLPATTLAPGAPHPFHLHGHVFAVVRSAGSTAYNYVDPIFRDVVSTGTPAAGDNVTIRFHTDNPGPWFLHCHIDFHLEAGFAIVFAEDVADVKAANPVPKAWSDLCPTYDALAEGDL

SEQ ID NO: 293 - protein, 428 aa, Mycobacterium sp. JLS
MDDVTMPQTPAERTWHAQGHQPRPRTFTQSSKLQDVLYEIRGPVHEHASRLEAEGHRILKLNIGNPAPFGFEAPDVIMRDIIQALPYAQGYSDSKGIMPARRAVFTRYELVDGFPRFDVDDVFLGNGASELIQMVLQALLDNGDQVLIPAPDYPLWTACTSLAGGTPVHYLCDETQGWNPDVADIESKITDRTKAIVVINPNNPTGAVYSRETLERIADLARKHQLLLLADEIYDKILYDDAKHISLASVAPDVLTLTFNGLSKAYRVAGYRSGWLVITGPKEHASSFIEGISLLANMRLCPNVPAQHAIQVALGGHQSIDDLVLPGGRLLEQRDVAWEKLNEIPGVSCVKPAGALYAFPRLDPEVYEIHDDELLVLDLLLQEKILVVQGTGFNWPTPDHLRIVTLPWARDLANAIERLGNFLVSYRQ

SEQ ID NO: 294 - protein, 520 aa, Trametes sp. I-62
MAKLQFSNLFVTLAVVTGALAAVGPKADLTITNAVVAPDGFSRDAVVVNGVFPGPLITGKKGDRFQLNVIDNLTNHTMLKSTSIHWHGFFQAGTNWADGPAFVNQCPISTGHAFLYDFHVPDQAGTFWYHSHLSTQYCDGLRGPIVVYDPLDPHAFRYDVDDESTVITLSDWYHTAARLGPRFPLGADATLINGLGRSSSTPTANVTVINVQHGKRYRFRLVSLSCDPNHTFSIDGHNLTVIEVDGVNSKPLTVDSIQIFAAQRYSFVLNANQTVGNYWIRANPNFGTTGFAGGINSAILRYQGAPIVEPTTVQTTSVIPLVETNLHPLVPTIVPGLPVSGGVDKAINLAFNFNGTNFFINNATFTPPTVPVLLQILSGASTAQDLLPPGSVYPLPAHSSIEITLPATTLAPGAPHPFHLHGHVFAVVRSAGSTAYNYVDPIFRDVVSTGTPAAGDNVTIRFHTDNPGPWFLHCHIDFHLEAGFAIVFAEDVADVKAANPVPKAWSDLCPTYDALAEGDL

SEQ ID NO: 295 - protein, 170 aa, Nostoc punctiforme PCC 73102
MSNIGLFFGTQTGNTQTESEIIQKEFGGDSVVTLYDISQAEPSDFNNYDYIVVGCPTWNVGELQSDWENFYDELDNIDFIGKKVAYFAPGDQVGYPDTFQDALGILEEKISENGGETVGYWPTEGYEFSESKAVRDGKFVGLALDEDNQSDLTEERIKAWVTQLKPEFGL

SEQ ID NO: 296 - protein, 384 aa, Staphylococcus aureus subsp. aureus NCTC 8325
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPLFIISDEIYAENTFSGKHVSFAEFEDIRDQLILIGGLSKSHSATGIRIGFLLGPQYLIDKLTFMHAYNCIFANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 297 - protein, 163 aa, Campylobacter lari RM2100
MSIAVIYGSSMGNTEGAANIIAQKLGISDVLNIADINAEKINSYDKLICGTSTWGSGDFQDDWDGFDFSALNLSGKTVAVFGMGDSESYSDTYCSAMGKLAQALKAAGANLVGAVSTGGYTFESSEAVEGDKFVGLALDNDNHEDLTESRIDAWLEQIKPHFS

SEQ ID NO: 298 - protein, 201 aa, Populus trichocarpa
MGYGEKDISLVSFQSVSKGYYGECGKRGGYMEVTGFGPEIREQIYKVASVNLCSNISGQILASLVMSPPKVGDESYESYSAEKDGILSSLARRAKTLEDAFNNLEGVTCNKAEGAMYLFPCICLPEKAIKAAEAAKTAPDNFYCRRLLNATGIVFVPGSGFGQLPGTWHFRCTILPQEDKIPAVVSRLTEFHKSFMDEFRD

SEQ ID NO: 299 - protein, 624 aa, Cryptococcus neoformans var. grubii
MRGVVKLFFLSCSLVSLVSSEETGKSPTANYDHYMPEATATIDPSVFALSNDFEITDVPTTREYTFDITKALASPDGYEREVYVVNNMFPGPVIEANTGDTIIVHVNNHLEEGQSIHWHGLRQLGTAFMDGVPGITQCPIPPGSSFTYQFTVSHQSGTFWWHSHYSNSMADGIWGPLIIHSPNEPLQRGRDYDEDRIVFITDWVHDNSEVVIAALATPEGYKGSPAPPQGDAILINGRGQTNCTATGSSSCTYPPPPEIHVPVNCRVRLRFISATAHPMYRITIDNHPLEVVETDGTAVYGPTVHEISIAPGERYSAIINTSEGKEGDAFWLRTSVALGCMFGGTDQVGLAVVRYTGNGMVSTEEPQTTAWSDLAGATTPCAGLDQTYTLSPRESFSAPREFSQSHVFNSQRGAFVNVYGNTFQGYGFNNISYQNQIFNPLLSIVQRGGSCESTLVASTTFPDLGSGNIIINNLDGVIDHPYHLHGNEFQVIGRGTGALSLDNLTNIDFNLDNPVRKDTLWIQGGSWVVLRITTDNPGVWALHCHIGWHLTEGKLAVVVIQPGAIGHMEGPESWTNLCANTDPNAFGPARRSPSPSIQSSKTSTFQYLREVKGKVVKRRGAREA

SEQ ID NO: 300 - protein, 541 aa, Arabidopsis thaliana
RFVIGQAKNLIDQSRRRQLHHHKNLSFVSLIPPFSAPSDSSSRHLSSSSSSDMSASDSSSSLPVTLDTINPKVIKCEYAVRGEIVNIAQKLQEDLKTNKDAYPFDEIIYCNIGNPQSLGQQPITFFREVLALCSYTALLDESATHGLFSSDSIERAWKILDQIPGRATGAYSHSQGIKGLRDAIADGIEARDGFPADPNDIFMTDGASPGVHMMMQLLITSEKDGILCPIPQYPLYSASIALHGGTLVPYYLDEASGWGLEISELKKQLEDARSKGITVRALAVINPGNPTGQVLSEENQRDVVKFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 301 - protein, 521 aa, Chlamydomonas reinhardtii
MRKEATRLVSALLRAGNNGVSTSWAVGGTRLKSAMPQPDEKKDEDLHAKEGKVLHPHLLNENVVKTQYAVRGELYLRAEQLRKEGKEIIFTNVGNPHALGAKPLTFTRQVLALCAAPFLLDHPKVEDMFPADAIARAKKILASFKGGVGAYTDSRGNPLVREEVARFIEKRDGVPSNPDHIFLTDGASVAVRLCLNAMIRHDRDSVLVPIPQYPLYSASIRLYGGTLVGYFLDERRGWGLSVEELQRALQESREEGKLVRGLVFINPGNPTGQCLSKENLQELIKLAYQEKIVLMADEVYQENVYQDERPFVSAKKVMWEMGEPYRSHVELLSFHTVSKGTAGECGLRGGYVEMTNIHPGAIEEVYKCASINLSPNTMGQIALSVLVNPPKPGDPSYDQYTKEKASELVSLRRRRHMVTDGFNALDGVTCNFTEGAMYSFPQIKLPAKALEAAKAAGKAGDVFYCLKLLEATGISTVPGSGFGQEEGTFHLRTTILPREEVMTTFVEKFDKFHKDFMKQYS

SEQ ID NO: 302 - protein, 390 aa, Robiginitalea biformata HTCC2501
MIEEARRLSAVKEYYFSSKLREVRGLMAEGRPVINMGIGSPDLAPSQAVLESLTASVREAGAHQYQSYQGLPELRQTISEFYNRKFGVSLDPDSEILPLMGSKEGIMHISMAFLNPGDKVLIPDPGYPTYAAVTRLVGAEPIHYRLSGESGWFPDLEALSQSDLSGVKIMWASYPHMPTGAKASREQLSELVAFAHRHQILLVNDNPYSFVLAREPISILDIPEASGHVLELNSLSKTFNMAGWRVGMALGDKRLIAAVLKVKSNMDSGMFYGIQKGAIAALKSDPEWFKGLDAIYSRRRAAVHELADLLGCSYDKEAVGMFVWARLPKGSPDAETYIDGLLYNHNIFVAPGTIFGSRGAGYIRFSLCVPEEKIREALGRIQTAVTKKEV

SEQ ID NO: 303 - protein, 624 aa, Cryptococcus neoformans var. grubii
MRGVVKLFFLSCSFVSLVSSEETGKSPTANYDHYMPKATATIDPSVFALSNDFEITDVPTTREYTFDITKALASPDGYEREVYVVNNMFPGPVIEANTGDTIIVHVNNHLEEGQSIHWHGLRQLGTAFMDGVPGITQCPIPPGSSFTYQFTVSHQSGTFWWHSHYSNSMADGIWGPLIIHSPNEPLQRGRDYDEDRIVFITDWVHDNSEVVIAALATPEGYKGSPAPPQGDAILINGRGQTNCTATGSSSCTYPPPPEIHVPVNCRVRLRFISATAHPMYRITIDNHPLEVVETDGTAVYGPTVHEISIAPGERYSAIINTSEGKEGDAFWLRTSVALGCMFGGIDQVGLAVVRYTGNGMVSTEEPQTTAWSDLAGATTPCAGLDQTYTLSPRESFSAPREFSQSHVFNSQRGAFVNVYGNTFQGYGFNNISYQNQIFNPLLSIVQRGGSCESTLVASTTFPDLGSGNIIINNLDGVIDHPYHLHGNEFQVIGRGTGALSLDNLTNIDFNLDNPVRKDTLWIQGGSWVVLRITTDNPGVWALHCHIGWHLTEGKLAVVVIQPGAIGHMEGPESWTNLCANTDPNAFGPARRSPSPSIQSSKTSTFQYLREVKGKVVKRRGAREA

SEQ ID NO: 304 - protein, 670 aa, Medicago truncatula
MCFSITFTGSTNDALYKELWHACAGPLVTLPREGERVYYFPQGHMEQLEASMNQGLEQQMPSFNLPSKILCKVVNIHLRAEPETDEVYAQITLLPETDQSEVTSPDDPLPEPPRCTVHSFCKTLTASDTSTHGGFSVLRRHADDCLPPLDMTQQPPWQELVATDLHGNEWHFRHIFRGQPRRHLLTTGWSVFVSSKKLVAGDAFIFLRQVVLGENGELRVGVRRLMRQQSNMPSSVISSHSMHLGVLATASHAISTGTLFSVFYKPRTSRSEFIVSINKYLEARNHKLSVGMRFKMRFEGDEVPERRFSGTIVGVEDNKSSVWADSEWRSLKVQWDEPSSILRPDRVSPWELEPLVSTPPANSQPTQRNKRSRPPILPSTMTDSSLQGIWKSPADSPPFPYRDPQHGRDLYPSPRFSSTATSFLGFGGNSPASNKSMYWSSRLENSTEPFSPVALEESGEKRQGTGNGCRLFGIQLLENSNAEESLQTAPLSGRVGDDRSVPSLDVESDQHSEPSNVNRSDIPSVSCDADKSCLRSPQESQSRQIRSCTKVHMQGMAVGRAVDLTRFDGYEDLLRKLEEMFDIEGELCGATKKWLVVYTDNEDDMMMVGDDPWLEFCSVVRKMFIYTPEEVKKLSPKIGLPSNEEGKPSKLDSEAVVNPEDRSSIVGPGC

SEQ ID NO: 305 - protein, 175 aa, Photobacterium profundum SS9
MASVGLFFGSDTGNTEAVAKMIQKQLGKNLVEVKDIAKSSKEDIDNFDLLLLGIPTWYYGEAQCDWDDFFPELENIDFSTKLVAIFGCGDQEDYAEYFCDAMGTVRDIIEGRGATIVGHFSTEGFEFEASKALVDDNNFVGLCVDEDRQPELTDERVAKWVKQIFEEMCLAELAD

SEQ ID NO: 306 - protein, 576 aa, Physcomitrella patens subsp. patens
MIVVNGQFPGPAIRANEDDIVIVNVTNLVAAPVTIHWHGVKQIRTCWADGVPYITMCPLQQNQSFSHRFQLLNQTGTMWYHAHISWLRASVHGPIVLRPRKFESFPFTSPKREITIMIGEWWNNDVEDVLAYALARGGRYNISDAITLNGQPGFLYNHSSKDALKVKVTHGETYLLRVVNACLNFGMFFGVANHSLKVVQLDSAYVKPFTVNTVLIAPGQTLDALLTANRASGRYYMAASPYSVPDPQYVPFPEIPATARMEYEESSYEIERSSSEIVTYMPTFPSPNDSNYRHKFDDLQKSINTTYQTLDVPETVDKHLFFTVGYGLDKSSSCHPFKTCVDGYDGQYRVVGSVNNISFVTPNTTSKSLLEIAYLRDHGNASVTSALDLDFPSQPTMTFNYTGSTRLPLSQWFSKHATKLSVINYNASVQIILQNTNIVQFETHPFHLHGYSFYIVGRGNGNYDPDSSPATFNLVDPPLRNTFGVPHRGWLALRFRADNPGVWLFHCHFEIHTSWGMETVLYVKEGTGTNQTLEAPPSDLPACASSENTSKKKEPTVSITISEDITKPEISKEVPH

SEQ ID NO: 307 - protein, 63 aa, Glycine max
KFLEPRGKSPVPGSGFGQKKGGFHFRPIIFPAKENNPDIMESFKKFNHEFWGQLEDDKGFSRL

SEQ ID NO: 308 - protein, 589 aa, Zea mays
MGSKNLSSSQMIRANLPPSASRIHAPAPAPSSVAIPASTAPHRTVSAAMRRFAADRARRAVAASLHGAASRSAAPSPHAPAPRHPASPVGAAAMAAAMVRTMSTTAAGTPPVSVATINPKVLKCEYAVRGEIVTHAQNLQQELQKNPESLPFDEILYCNIGNPQSLGQQPVTYFREVLSLCDHPALLDKSETHALYSSDAIERAWQILEKIPGRATGAYSHSQGIKGLRDEIAAGIAARDGFHASGDNIFLTDGASPAVHMMMQLLISSESDGILCPIPQYPLYSASIALHGGSLVPYFLNEETGWGLDVDELKKQLEEARSKGITVRALVVINPGNPTGQVLVEENQKKIVEFCKNEGLVLLADEVYQENIYVEDKPFHSFKKIARSLGYTDDDLPLVSFQSVSKGYYGECGKRGGYMEITGFSPDVREQIYKVASVNLCSNVSGQILASLVMNPPKAGDESFESFMSERDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSRLKEFHEKFMDEFRD

SEQ ID NO: 309 - protein, 393 aa, Desulfitobacterium hafniense Y51
MGGKVLKARRLSSLGASVFTEMDDLRKELEKAGKQLINLSIGSPDRSPSAEIRKVLAEGVLDGGSYGYTLTRGTESFRSGCARWYKERFGVNLDPEKEVLPLMGSQDGLAHIFLALCDPGDVALIPDPGYPIYTAGLVLAGGEKVALPLREENGFLPDLSAIADEVAQQAKIMFLNYPNNPTAAVAPLSFFEEVVDFARKNRIVVCHDAAYSELAFDGYRPVSFLQVPGAKEVGIEFHSVSKTYNLAGVRLGFAVGNREIIGALAELKSNIDYGVFEPALQAGAYALSASQENVEQNRRAYQERRDIWVKGCAQAGWSMPSPRGSMFIWAPVPTAQDSRSFAFALAREAGVIVVPGVAFGEYGEGYVRIGMVQDQEVLQEAVRRVQEFLAAQG

SEQ ID NO: 310 - protein, 404 aa, Vibrio salmonicida LFI1238
MQNIAMSSKLSSVCYDIRGPVLKHAKRMEEEGQKILKLNIGNPAQFGFDAPEEILVDVIKNLPTSQGYGDSKGIYSARKAVVQHYQRRGLLDLDVEDVYIGNGASELIVMAMQALLNNGDEMLVPAPDYPLWTAAVSLSGGNPVHYLCDEGADWYPDLDDIKKKITPNTKGIVLINPNNPTGAVYSRDFLLQIVEIARQNNLIIFADEIYDKVLYDGAIHTTLATLAPDLLTVTFNGLSKAYRVCGFRGGWMFLNGPKDHAQGYIAGLDMLASMRLCANVPMQHAIQTALGGYQSINELLLPGGRLLEQRDKAYELITQIPGVSCVKPKGAMYLFPKLDPKMYKIKDDQKFVLDFLIKEKVLLVQGTGFNWPTPDHFRIVTLPRVDDLEVAIGRLERFLHTYKQ

SEQ ID NO: 311 - protein, 174 aa, Haemophilus somnus 129PT
MAIVGLFYGSDTGNTENIAKMIQKQLGSELIDIRDIAKSSKEDIESYDFLMIGIPTWYYGEAQCDWDDFFPTLEEIDFTDKLVAIFGCGDQEDYAEYFCDAMGTVRNIIEPKGAIIVGHWPTEGYTFEVSQALVDDNTFVGLCIDEDRQPELTAERVEKWVKQVYDEMCLAELA

SEQ ID NO: 312 - protein, 499 aa, Aspergillus nidulans FGSC A4
MTTRTTVPNASQRALSTAAVRCLTLDNINSNVKAAKYAVRGELAVKAEEYRVRLAQGDKTLPFDSVIFANIGNPQQLDQKPITFFRQVLSLMENPLLLSNKDALRTSFGYQDDVIERAEKLLAEVQSVGAYSHSQGAPLIRESVAKFIEERDGFPADPQSLYLTGGASSGVNTILNVICNGPNAGVLVPIPQYPLYTATLSLLNAQCVPYHLEEQKAWGTDIGTIKKSLEQAKAAGTDVRAIVVINPGNPTGASLSPADIKSVLDIAAEEKLVVIADEVYQTNVFIGEFTSFKKRLRELQQEVPGKYDNVELVSLHSTSKGMVGECGHRGGYFELVGFDPLVAAQVYKFISIMLCPPVIGQCLVELMVNPPKEGEPSHELYQKEYNGIREGLRQRAFALYEAFQRMEGVECQEPQGAMYLFPTISLPPKAIEAAAAENRAADEFYCLRLLDATGVCVVPGSGFGQKENTLHFRTTFLAPGTDWVERIVKFHSEFMAKYK

SEQ ID NO: 313 - protein, 520 aa, Trametes sp. I-62
MSRFHSLLTFIVASLASSALASIGPVADMTISNAEVSPDGFARQAVVVNGVTPGPLVKGNMGDRFQLNVIDNLTNHTMLKSTSIHWHGLFQHGTNWADGPAFVNQCPVSAGHSFLYDFQVPGQAGTFWYHSHLSTQYCDGLRGPLVVYDPHDPHKSRYDVDNDDTVITLADWYHVAAKRRSAFPLGADATLINGLGRSPTTPSADLAVINVTQGKRYRFRLVSLSCDPNHTFSIDGHNMTIIEVDSVNSQPLVVDSIQIFAAQRYSFVLNANQAVDNYWVRANPSFGNVGFSGGINSAILRYAGAPAIEPTTNQTTSVIPLNEVNLHPLAPTPVPGKAVAGGVDTPINMAFSFNGTNFFINGASFVPPTVPVLLQILSGAQSAQDLLPSGSVYVLPSNASIEISFPATAAAPGVPHPFHLHGHTFAVVRSAGSTEYNYDNPIFRDVVSTGTPAAGDNVTIRFQTNNPGPWFLHCHIDFHLEAGFAVVMAEDTPDVKAVNPVPQSWSDLCPIYDALDASDL

SEQ ID NO: 314 - protein, 524 aa, Trametes sp. I-62
MSGFRLLPSFASLAVIVSLALNTFAAVGPVTDLTISNANVSPDGFQRAAVVANGGVPGPLINGQKGDHFQINVVNQLTNHTMLKSTSIHWHGFFQKGTNWADGPAFVNQCPIATGHSFLYDFQVPDQAGTFWYHSHLSTQYCDGLRGPFVVYDPNDPHASLYDVDNEDTVITLADWYHVAAKLGPAFPPRADATLINGLGRSTDTPTADLAVIKVTSGKRYRFRLASLSCDPAFTFSIDNHDMTIIEADAVNTQPLEVDSLQIFAGQRYSFVLEANQAVDNYWVRANPFFGTTGFAGGINSAILRYDGAAEVEPTTTQSTSTKPLAETDLVPLASMPVPGSPVSGGVDKGINFAFTFNGTNFFVNGATFTPPSTPVLLQIMSGAQDASALLPSGDVYSLPSNATIELTFPATTGAPGAPHPFHLHGHTFAVVRSAGSTKYNYDNPIWRDVVSTGTPAAGDNVTIRFRTDNPGPWFLHCHIDFHLEAGFAVVMAEDIPDTKLANPVPQAWSDLCPIYDALDPSDQ

SEQ ID NO: 315 - protein, 481 aa, Glycine max
MPPKPLDYGSINENVKKSQYAVRGELYLRASELQKEGKKIIFTNVGNPHALGQKPLSFPRQVVALCQAPFLLDDPNVGLLFPADAIARAKHYLSLTSGGLGAYSDSRGLPGVRKEVAEFILRRDGYPTDPELIYLTDGASKGVMQILNTIIRGQDDGILVPVPQYPLYSATIALLGGTLVPYYLEETANWGLDVNELRQSVEQARFKGITVKAMVIINPGNPTGQCLSEANLREVLQFCYQENLALLGDEVYQTNIYQDERPFISSRKVLMDLGPPISKEVQLISFHSVSKGYYGECGQRGGYFEMTNIPPETVDEIYKVASISLSPNVPAQIFMGVMLHPPQPGDISYDKFVRESTGILESLRRRARLMTDGFNSCRNVVCNFTEGAMYSFPQIRLPPRALEAAKQAAKVPDVFYCLKLLEATGISTVPGSGFGQREGVFHLRTTILPDEEDMPAIMDSFKKFNDEFMEQYEDNRGYSRL

SEQ ID NO: 316 - protein, 173 aa, Klebsiella pneumoniae subsp. pneumoniae MGH 78578
MNIGLFYGSSTCYTEMAAEKIRDIIGPELVTLHNLKDDSPALMSQYDVLILGIPTWDFGEIQEDWEAVWDQLDTLNLEGKIVALYGMGDQLGYGEWFLDALGMLHDKLATKGVKFVGYWPTEGYEFTSPKPVIADGQLFVGLALDETNQYDLSDERIQSWCEQILGEMAEHFS

SEQ ID NO: 317 - protein, 474 aa, Rhodococcus sp. RHA1
MKDSVPHGTSDFVVVANRLPVDMETLDDGTTRWKRSPGGLVTALEPILHDRERGSWVGWPGVPDTKVEPIVSGGVDLYPVELSSDEVKLYYEGFSNATLWPLYHDVLVAPVFDRDWWHSYLDVNRHFAEETARTAAEGATVWVQDYQLQLVPRLLREMRPDLTIGFFLHIPFPPVELFMQLPWRKEIVEGLLGADLIGFHLPGGANNFLFLARRLLGLDTTTAGVGVRSALGKVTLDGRVVQVGAFPISVDSRQLVEQATDPAIVERAAEIRRELGNPRKILLGVDRLDYTKGIDLRLSALGELLDEGRLDPSDTAMVQLATPSRERVEHYMKMRSSIEEQVSHINGDHGQIGRPFVHYLYQPVDRSELIALFLAADVMLVTPMRDGMNLVAKEYVACRADLGGALVLSEFAGAAAELRGAYLVNPHDLDGVKNTIMAALDPEREQGRRRMSRLHRQVLDHDVHRWAQSFLGAL

SEQ ID NO: 318 - protein, 313 aa, Schizosaccharomyces pombe
ERRKMIERESYKQVTTHTMQSWTSSLIRSLANKLAATKTDQRIPTLTPEHALSVYSKASKRLFMMDYDGTLTPIVRDPNAAVPSKKLLDNLATLAADPKNQVWIISGRDQQFLRNWMDDIKGLGLSAEHGSFVRKPHSTTWINLAELLDMSWKKEVRRIFQYYTDRTQGSSIEEKRCAMTWHYRKADPENGAFQALECEALLEELVCSKYDVEIMRGKANLEVRPSSINKGGIVKQILSSYPEDSLPSFIFCAGDDRTDEDMFRSLHKNTRINKETSFAVTIGSDKKLSIADWCIADPANVIDILADLANFTN

SEQ ID NO: 319 - protein, 891 aa, Schizosaccharomyces pombe
MGRQFICSIYLPYTINFHLDELEGNHESHPAITHQEKVTQTHRDSVKIDDILTRLSISKSESGQATPVLTPQLEGMNDYFSLGPSKRTGGSMTPGLGAMSPIPGSGRSSPLYTQPRSRATSPSRVRQADRFAAPGIGAGALPIRRKRRDSLAKSVALFESARWSVERGVVGNSGLFHAVDAAVRDHGLQNPLWVGLLGMPTESLSEKTKNAISGALLVKHQSLVVYTSDSNFEGHYNHYCRKILWPSLHYQHNEIFSFFHEESNWDDYVAVNRAFADALIKNYKTGDTIWVNDYHLLLVPNMVRERIPSAIIGLFIHVSFPSSEVFRCFARRKELLQGMLGSNLIGFQTEEYKRHFLQSCSRVLYAESTFDRILLDDRYIDVYAHPIGADPVLVDKWLENPETLEVKEVLEKRYANLNIFVGCDKMDPIRGIREKLLAFEQFLYDNPEYQKNTILIQTSTFTEEQKEYGVAISDIVTRINSAFGDFSLDHLPVTILSSDLSYPQYLALLSVADAFIVTSLREGMSLTCHEFILTQRQKKSPLIVSEFIGCASMFSNGAFIVNPWSTLELSLSMKKALTLSTNERNQRYSNCLDVVLTHSASNWVTGFETKLKKSWTSQQKRDFSRLPRFTLNFIGNRYDHAKKRLLILNFDGNAVTWEGRHEFVDFHYGYMVSILSKLIADDRNIVYIASCLEEDELESLFMHVPGVGLIAENGCYVLPHYAENVHQSWIRLYKKQQMDWREPLHDIIQYYSERTPGSSLIDHGFAMEFNYVKAENRENGLRSAGELASSINETQHGCRAVPLDGRVLCEPTTISKATAANYIMTHLIKNPEELDLILVAGNNRTDESVFAWANKSKVSSFTVSMGVGNTEAKAYTDGIPSFFNVLNSLCA

SEQ ID NO: 320 - protein, 624 aa, Cryptococcus neoformans var. grubii
MRGVVKLFFLSCSLVSLVSSEETGKSPTANYDHYMPEATATIDPSVFALSNDFEITDVPTTREYTFDITKALASPDGYEREVYVVNNMFPGPVIEANTGDTIIVHVNNHLEEGQSIHWHGLRQLGTAFMDGVPGITQCPIPPGSSFTYQFTVSHQSGTFWWHSHYSNSMADGIWGPLIIHSPNEPLQRGRDYDEDRIVFITDWVHDNSEVVIAALATPEGYKGSPAPPQGDAILINGRGQTNCTATGSSSCTYPPPPEIHVPVNCRVRLRFISATAHPMYRITIDNHPLEVVETDGTAVYGPTVHEISIAPGERYSAIINTSEGKEGDAFWLRTSVALGCMFGGIDQVGLAVVRYTGNGMVSTEEPQTTAWSDLAGATTPCAGLDQTYTLSPRESFSAPREFSQSHVFNSQRGAFVNVYGNTFQGYGFNNISYQNQIFNPLLSIVQRGGSCESTLVASTTFPDLGSGNIIINNLDGVIDHPYHLHGNEFQVIGRGTGALSLDNLTNIDFNLDNPVRKDTLWIQGGSWVVLRITTDNPGVWALHCHIGWHLTEGKLAVVVIQPGAIGHMEGPESWTNLCANTDPNAFGPARRSPSPSIQSSKTSTFQYLREVKGKVVKRRGAREA

SEQ ID NO: 321 - protein, 159 aa, Bacillus licheniformis ATCC 14580
MSKALIAYASMSGNTEDIAMIIKDTLREYGFDVTIQEMDDVDTDSLAEYDLLLIGTYTWGDGDLPYEAESFYEEVSSLDLKGKKAACFGSGDYAYPRFCEAVNTFYTMLERTGADLYQETLKIELAPETDEDAECCKEFAEGFIRWAEQQKRRAEIHVS

SEQ ID NO: 322 - protein, 175 aa, Photobacterium sp. SKA34
MASVGLFFGSDTGNTEAVAKMIQKQLGDKLVEVKDIAKSSKEDIDNFDLLLLGIPTWYYGEPQCDWDDFFPELEQVDFSTKLVAIFGCGDQEDYAEYFCDSMGTVRDIVEGRGATVVGNFSTEGFEFEASKALVDDNHFVGLCIDEDRQPELTAQRVKQWVEQIYDEMCLAELAD

SEQ ID NO: 323 - protein, 402 aa, Streptomyces anulatus
MEFRQSSKLSEVCYEIRGPVIEHANALEEAGHSVLRLNTGNPALFGFEAPEEIVQDMIRMLPQAHGYTDSRGVLSARRAVAQRYQALGLDEVSVDDVFLGNGVSELVTMAVQALLEDGDEILIPAPDFPLWTAVTTLSGGKAVHYVCDEAADWYPDLDDMASKITDQTKAVEIINPTGAVYPKEILEGILDLARRHGLMVFADEIYDQILYDDAVHHSVAALAPDLVVLTFCGLSKTYRVAGFRSGWLVITGPRQHARDYLEGLTMLASMRLCPNAPAQFAIQAALGGRQSIRELTAPGGALHEQRDRAWEKLNEIPGVSCVKPKGALYAFPRLDPKVHPIHDDEKFVLDLLLQEKIQVVQGTGFNWPRPDHFRILTLPHADDLDAAISRIGRFLSGYRQGR

SEQ ID NO: 324 - protein, 150 aa, Bacillus licheniformis ATCC 14580
MGKVLLVYASMSGNTEAMADLIEKGLLEGGAEVDRHEAMDVDAALFNDYQHMIFGAYTWGDGELPDEFLDIYDDMEGMDFIGKTFAVFGSGDTSYEHFCGAVDILEDKIKELGGNVVLPSVKIEMNPEDEEEGMLLQFGRDFAKKCEVPA

SEQ ID NO: 325 - protein, 585 aa, Fusarium oxysporum
MGNTNSSPFNLGDLGQLSQLQTNGESSYGTFDAPDLPTFLTDNPTPNGYPWSTMNSQTNYYQDQPNTGVIRRYDFTVSRGMIAPDGYELSTILVNGQFPAPLIEANWGDTIQVTVHNDMDDEGVSLHWHGILQKGMPWEDGVPGVTQCPIPPKKSFTYQFLADLYGTSWYHSHYSAQVAAGLFGPLVIYGPREKKDYDIDIGPVMLSDWYHKEYFDLVEEIMKPGGNGVVLSDSNLINGKMNFNCSSVAPGDKTPCKSNAGISKFRFKRGKVHRLRLINPSAEAIQRFSIDGHTMKVIANDFVPVQPYDTKVVTLGVGQRTDVLVRADGKLDSYWMRSNISAICSLGRAPAALAAIYYDNTNQKKAPKSQAWDIPDPGTCANDDLSITKPVMKLPLPPADKTIELDISSFKNASNVTLWTLGGVAARINYNSPTLLLSKLGNHTFEPEWNVINTGKAKSVRVVVNNKTPVAHPMHLHGFNMYVLHEGPGSWDGTIINRHNPQRRDVVQIRGNGHLVIQFDAGENPGVWPFHCHIAWHVSAGFLTQFLTNPDQVKKLRIPNVVAETCRQWGHWTLSNIPAQIDSGL

SEQ ID NO: 326 - protein, 624 aa, Cryptococcus neoformans var. neoformans
MRGLAKLFFLSCSFVSLVSSEKTDESPTAVSDNYMPKATATIDPSVFALSNDFEITDVPTTREYTFDIAKAFASPDGYEREVYVVNNMFPGPVIEANTGDTIIVHVNNHLDEGQSLHWHGLRQLGTAFMDGVPGITQCPIPPGGSFTYNFTVSHQSGTFWWHSHYSNSMADGIWGPLIVHSANEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISVAPGERYSAIINTNEGKEGDAFWLRTSVALSCMFGAVSQEGLAVVRYTGNGMVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPARRSSSPSIQSSKTSSFQYLREVKGKVVKRRGAREA

SEQ ID NO: 327 - protein, 478 aa, Candida albicans SC5314
MVQGKVLVVSNRIPVTIKRLDNGSYDYSMSSGGLVTALQGLKKTTEFQWYGWPGLEIPEDEQTKVNDELKSKFNCTAIFLSDTIADLHYNGFSNSILWPLFHYHPGEMNFDENAWAAYIEANKKFALEIVKQVNDDDMIWVHDYHLMLLPEMLRQEIGNKKKNIKIGFFLHTPFPSSEIYRILPVRKEILEGVLSCDLIGFHTYDYARHFISSVSRIVPNVSTLPNGIKYQGRSISIGAFPIGIDVDNFIDGLKKDSVVERIKQLKSKFKDVKVIVGVDRLDYIKGVPQKLHAFEVFLNENPEWIGKVVLVQVAVPSRGDVEEYQSLRSTVSELVGRINGEFGTVEFVPIHYLHKSIPFDELISLYNISDVCLVSSTRDGMNLVSYEYIACQQDRKGVLILSEFAGAAQSLNGALIVNPWNTEDLSEAIKESLTLPEEKREFNFKKLFTYISKYTSGFWGESFVKELYKCNPQKSLRD

SEQ ID NO: 328 - protein, 566 aa, Fusarium oxysporum
MKLLQFLPAGVLCLSQVYARSPLHQLNRRACSGNTASTRSEWCDYSIDTDYSTEAVDTGVTREYWLELTDVTVAPDGYSRSAMAVNGTIPGPTLFADWGDTVVIHVTNSLSTSLNGTSMHWHGIRQNYTNQYDGVSSITQCPLAVGESVTYTWKATQYGSTWYHSHWALQAWQGIFGGIIINGPATADYDEDLGMVFLNDWDHQTVDELYSSAETNGPPTLDNGLINGTNVYGDDDSSSQTGTRFNVSFESDTSYRMRLVNAAVDTHWKFSIDNHTLTVIAADLVPIEPFETTVLDLGMGQRYDIIVTADQADVADNFWMRAIPQAACSDNDSTDNIKGIVYYGDSPGTPSTTAYDYTDGCDDETDNIVPYISKTVEDANWNNLETATVGKNTAGLFKWMLNSTSMLVDWANPTLAQVLNDTTDFETDDAMIELSEGNQWVYFVVETALPVPHPIHLHGHDFFILAQGTGTYSSSITLNTDNPPRRDTAMLPANGYLVMAWETDNPGVWLCHCHIGWHTSEGFALQFLERSSEIANISTSSYVSDVCDGWSTFQSESLIEQEDSGV

SEQ ID NO: 329 - protein, 480 aa, Rhodococcus opacus
MKDTAPYGTSDFVVVANRLPVDMETLDDGTTRWKRSPGGLVTALEPILHDRERGSWVGWPGVPDTKVEPIVSGGIDLYPVELSSTEVSLYYEGFSNATLWPLYHDVLVAPVFDRDWWHSYLDVNRHFAEETARTAAEGATVWVQDYQLQLVPRLLREMRPDLTIGFFLHIPFPPVELFMQLPWRKEIVEGLLGADLIGFHLPGGANNFLFLARRLLGLDTTTAGVGVRSALGRVTLDDRVVQVGAFPISVDSRQLVEQATDPAIVERAAEIRRELGTPAKILLGVDRLDYTKGIDLRLSALGELLDEGRLDPSDTVMVQLATPSRERVEHYMKMRSSIEEQVSHINGDHGQIGRPVVHYLYQPVDRSELIALFLAADVMLVTPMRDGMNLVAKEYVACRADLGGALVLSEFAGAAAELRGAYLVNPHDLDGVKNTIMAALDPEREQGRRRMSRLHRQVLDHDVHRWAQSFLGALSPVAGD

SEQ ID NO: 330 - protein, 495 aa, Rhodococcus opacus
  misc_feature (48)..(48): Xaa can be any naturally occurring amino acid
MAASSESSASSSRSTSDPVSGQADFVVVANRLPVDLERLPDGTTRWKXSPGGLVTALEPILRRNKGAWVGWAGVADAELDPVVEDDLELYPVPLSAAEIADYYEGFSNATLWPLYHDVIVKPEYNRDWWNAYVEVNRRFAEATSKAAAHGATVWIQDYQLQLVPKMLRMLRPDLTIGFFLHIPFPPVELFMQMPWRTEIIEGLLGADLIGFHLPGGAQNFLYLARKLAGQQTSRGNVGVRSKLGVVQVGFRTVRVGAFPISIDSGQLDEQSRSKSIRDRAKKIRKELGNPKHIMLGVDRLDYTKGIDVRLAALHELLDEQRIDPADTVMVQLATPSRERVDSYVQMRDDIERKVSRINGEYSEVGRPVVHYLHRPIPREELIAFFVAADVMLVTPLRDGMNLVAKEYVACRSDLGGALLLSEFTGAAAELRQAFLCNPHDLDSVKDAMKQALNQPQKDGRRHMRALRRQVLAHDVDRWARSFLDALAHGAPPARH

SEQ ID NO: 331 - protein, 209 aa, Salmonella enterica subsp. enterica serovar Paratyphi B str.
MLFPHICLFCYDCPYPWAIRHHHFNKFQEVILLMAITGIFFGSDTGNTENIAKMIQKQLGKDVADVHDIAKSSKEDLEGYDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTAERVEKWVKQVSAELHLDDILNA

SEQ ID NO: 332 - protein, 168 aa, Bacteroides thetaiotaomicron VPI-5482
MNKIGVFYGSTTGTTEDLARRIAEKLDVPSAHIYDVSKLTEALVGEYDVLVLGSSTWGAGELQDDWYDGIKVLKKCDLSHKYVALFGCGDSDSYSDTFCDAIGILYEELKDTRCKFCGAVDTAGYTFDSSIAVVNGKFVGLPLDEVNEDGQTDERISAWVEQVKQEIS

SEQ ID NO: 333 - protein, 546 aa, Fusarium oxysporum
MRILRLALLPAALAATVSYDFSIDWVRANPDGAFERSTIGINREWPIPRIEASIGDTVLVYVRNNLGNQSTSLHFHGLFMNGSNHMDGPSQVTQCPIQPGESFLYNFTITQPGTYWYHSHTESQYPDGLRGPLIIHDSKSPFKGKYDEELIMTISDWYHDQMQTLIPEFMRKGNPTGAEPVPQAALMNETQDLKVPVQTGKTYFLRLANIGAFAGQYFWIEGHNMTIVEVDGAYTKPAQANMVYLSAGQRCSVLIATKDDASANFPIVASMDTDLFDVLPDDLNWNVTGWLVYDEEMPLPKQSVVYDFDPYDDMDLVPYDEMVRLPEPSRSIELDVIMDNLRDGANYAFFNNITYRAPKVPTLYTALTSGKQATNPQIYGTYTHSFVLEKDEIVQLVINNRDDGRHPFHLHGHHFQVLHRSDDDAGDFDGSVEFAETPMRRDTVVVNGNGNVVLRFKADNPGVWLFHCHIEWHVTSGLIATFVEDPLALQASLKLPQNHLDACKAGNIPTVGNAAGNTDLLDLSGENVPPPRLPEGYVPQSLMRHR

SEQ ID NO: 334 - protein, 698 aa, Glycine max
MASTLKSGGIHTGAINDDLYKELWHACAGPLVTLPREGERVYYFPQGHMEQLEASMYEGLEQQMPSFNLPSKILCKVVNVHLRAEPETDEVYAQITLLPEADQSEVTSPDDPLPESPRVKIHSFCKTLTASDTSTHGGFSVLRRHADDCLPPLDMSQQPPWQELVATDLHGNEWHFRHIFRGQPKRHLLTTGWSVFVSSKKLAAGDAFIFLRGENGELRVGVRRVMRQQSNVPSSVISSHSMHLGVLATASHAIATGTLFSVFYKPRTSRSEFIVSVNKYLEVQSHKLSVGMRFKMRFEGDEIPERRFSGTIVGVGDNKSSSVWPDSEWRSLKVQWDEPSSILRPDRVSSWELEPLVSTTLANSQPTQRNKRARPLILPSTMPDSSLQGGFAGLVVQNFFVILLPILFFYIIIFLCAPGIWKSSVESTSFSYCDPQQGRGLYPSPKFNSSATNFIGFSGNSSVGSPSNKSIYWSNRMENNLESISAIALKEAGEKRQGTGNGCRLFGIQLLENSNAEGNLQTVTLSGRVGDDRSVPSLDAESDQHSEPSNANRSDIPSVSCDAEKSCLQSPQESQSKQVHMQGMAVGRAVDLTRFDGYEDLLRKLEDMFNIKTELCGSLKKWQVVYTDNEDDMMMVGDDPWDEFCSVVRKIFIYTAEEVKKLSPKIRLPMNEKVNPSKQDSEAIVNPEDQSSNMGPSC

SEQ ID NO: 335 - protein, 541 aa, Glycine max
MRKSAADRFRHLFNRSLLLLRHRHHHNHHPFPYSSSVSSLSPFSRSRFLSSTPFSMASDSPFPVTAQNINPKVLKCEYAVRGEVVTLAQNLQKDLQANPGSHPFDEILYCNIGNPQSLGQQPITFFREVLALCDHPAILDKSETQGLFSTDAIQRAWQIVDQIPGRATGAYSHSQGVKGLRDTIAAGIEERDGFPANPDDIFMTDGASPAVHNMMQLLIRSENDGILCPIPQYPLYSASIALHGGCLVPYYLDEATGWGLEIPELKKQLEAAKSKGINVRALVVINPGNPTGQVLGEANQRDIVEFCKQEGLVLLADEVYQENVYVPEKKFHSFKKVSRSMGYGENDITLVSFQSVSKGYHGECGKRGGYMEVTGFSAEVREQIYKVASVNLCSNISGQILASLVMSPPKVGDESYDSFMAEKENILASLARRAKTLEDAFNKLEGVTCNKAEGAMYLFPQIRLSEKAIKAAEAANATPDNFYCKRLLNATGVVVVPGSGFGQVPGTWHFRCTILPPEEKIPAIVTRLTEFHEKFMDEFRD

SEQ ID NO: 336 - protein, 396 aa, Myxococcus xanthus DK 1622
MKLAHRLQAIKPSPTLALNSRAKALVAKGVDVVVLAAGEPDFDTPDYVKQAAVDALRAGFTKYTPTNGIPELREAICAKLERDNGLRYTPDQVLVTSGGKQGLYNFCQAALEEGDEVIIFAPFWVSYPDMVRLAGATPVIVPTREEDGFAPDPDAIRRALTPRTRAVIINSPGNPTGAVYSRAALERIAEVLRPHDCLIVTDDIYEKLLYTDERLGISDVAPDLVPRLVVVNGMSKAYSMTGWRMGYVAGPKPLLAGMQMVQDQSTSNASSIGQKAALAALQGPPDTIAAMVKEYRERRDFFIAGLNALDGVRCRMPEGAFYAFADVRGLLGRSYKGKPVTSAMQLSEILLDDFRVAAVPGEPFGAEGYVRMSFVTSREVLQKGLARLGELVKALS

SEQ ID NO: 337 - protein, 147 aa, Deschampsia antarctica
QIFMGLMVNPPKPGDISYLKYATESKSILESLRRRAQIMTDGFNSCRNVVCNFTEGAMYSFPQIRLPQRAMDTAKSAGKAPDVFYCLMLLEATGISTVPGSGFGQKEGVFHLRTTILPAEEDMPAIMSSFKKFNDSFMEQYQDYSKL

SEQ ID NO: 338 - protein, 404 aa, Yersinia pseudotuberculosis IP 32953
MSPIEKSSKLDNVCYDIRGPVLKEAKRLEEEGNKVLKLNIGNPAPFGFDAPDEILVDVIRNLPTAQGYCDSKGLFSARKAIMQHYQARDIRDLTVEDIYIGNGVSELIVQSMQALLNLGDEMLVPAPDYPLWTAAVSLSSGKAVHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 339 - protein, 424 aa, Xylella fastidiosa 9a5c
MSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 340 - protein, 172 aa, Neptuniibacter caesariensis
MTKPIGLFYGSTTGNTETVAEQIIEQIGSDKIHHIDIAADGLDGLSEYEHLILGIPTWDFGELQEDWADLWDVLDAVHVEGKTCAVFGLGDQIGYAEWFLDAMGLLHDKMQERGAVMVGYWSADGYDFEASKALTEDQSQFVGLAIDEDCQRSETEERVARWSQQVVKGFGL

SEQ ID NO: 341 - protein, 153 aa, Triticum aestivum
AYLGDFIEQVCTKKLSVPVRNSRDIVDPRVRFFHPPFLLDDPNVCLIFPADAIERAKHYLSLAPGGLGAYSDSRGIPGVRQEVAEFFHRRDGYPSDPELIYLSDGTNRGVLQMLYSFSPIPEGSGFWSPESNNYAIFLWMDISILLVGFFLPP

SEQ ID NO: 342 - protein, 176 aa, Salmonella enterica subsp. arizonae serovar 62:z4,z23:--
MAITGIFFGSDTGNTENIAKMIQKQLGKDVADVHDIAKSSKEDLEGYDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTAERVEKWVKQISAELHLDDILNA

SEQ ID NO: 343 - protein, 208 aa, Zea mays
  misc_feature (19)..(19): Xaa can be any naturally occurring amino acid
  misc_feature (29)..(29): Xaa can be any naturally occurring amino acid
WGGDVFFLGYTDDDLALEXFQSVSKGYYXKCGKRGGYMEITGFSPEVREQIYKVASVNLCSNVSGQILASLVMNPPKAGDESFESFMSEKDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSRLKEFHEKFMDEFRD

SEQ ID NO: 344 - protein, 875 aa, Chlamydomonas reinhardtii
MWWFAGRLIIVSNHLPLRVKRATTSWEFEWDEDALVGQAKATGGIPSDLEVMYVGSLPVDVALEEQDAVAAQLKRLYNCCPVFMEKELKEKFYKGCCKQQMWPLFHYVLPMSPESSGRFDQEMWQAYVKANKAEAGDTVSCGWRGTWAVGSPHAHTLSLPRVLFQYMCAQQPLNCPSSLPLTTPSHSPPSPRPPLNTLTLLLPTGFHTFDYARHFLSCCSRMLGLEHETSRGSITIDYYGRTVGIKIMPTGVNPKRYLDGFSWDEFNGRGGWWVVATQGWVNHAAGSPWDSQKGVELKLLALERLLDTHPEWRGQLVLVQITNPPRSTGRDIAELHRCVLGLVDSINRKYGKGSYQPVQYLERHVPLHERMAFYSIADCAVVTATRDGMNLVPYEYVVCRQGPDGWDGGAAAGGAPGGGGSKRESMLVVSEFVGCSPSLSGAIRVNPWSVDRGERAGRVVYPSPTGGGRARGHVATRMVSFHPFVSTVAHRASVSPHRANGVTNNHLAMNCYRLGLGLDTFPMVALDANFKRLEELAVAAQLRKLGSHFRAFFLDYDGTLTGASPLSASAAASAASSSSGLTAGGHHGPGGLAPAEPLLAVLRALVADPRNRVFLFSSSPKADLTQWFASIPSLGLVAENGFFLRAIGSAAWETAVPHADFSWKRMAAPILQQYVESTDGSSVEAKESALVWHYRDADPDFGAWQAKELLDHLEGALSNKPVEIVGGQGYVEIKPQGVSKGRALERLLAAASAPASAPAAPAAAAAAASPPPAPSPSSSPAHGGLVGPRPAGAGSAAGGLGGPDFMLCVGDDRSDEDMYTSIENMKSLPTMTAEVFACTVGQKPSRAPFYLNDPVEVLQLLARLVNVPLTQQPVN

SEQ ID NO: 345 - protein, 479 aa, Oryza sativa
MLRAAARALTVSSLNPKVLALADHHLGGLVARRAQLVTVTVNILIVERKKILQADTSMQQELDANPASHPFSEVLALCNHPHLLDRSEASFMFSSDAITRAREIVGFIPGKTTGGYSHCQANSIVSEFRANADKYGNELSSNLTIFDRVHMMMHLLIRGKKDGILCPIPSHSLYTDSMVLRGATLVPYYLDESRGWSVNISDLKKQLDGARAKGIDVRGLVVVNPGNPTGQVLVEENQCEIVELCKNECLVLLADEVYQENIYTDQKKFNSFKKVARSIGYGEGDISLVSFHSVSNGYYGECGRRGGYMEVTGFSSEVRGEVYKVASLSACSNISGQILMSLVMNPPKVGDESYPSYRAERDSILSSLSCCAEAMVSTFNSMEGMTCNKAEGGISVFPSVRLPPRAIEAAEAMNTEPDVFYALRLLESTGIVVVPGSVFGQVPGTWHFRCTILPQEEKTRQIISRFNVFHEAFMEEFRS

SEQ ID NO: 346 - protein, 402 aa, Streptomyces avermitilis MA-4680
MEFRQSSKLSEVCYEIRGPVIEHANALEEAGHSVLRLNTGNPALFGFEAPEEILQDMIRMLPRAHGYTDSRGVLSARRAVAQRYQDRGLEVDVDDVFLGNGVSELVSMAVQALIEDGDEVLIPAPDFPLWTAVTTLAGGKAVHYLCDEQADWYPDLADMAAKITDRTRAVVIINPNNPTGAVYPKEIVEGILDLARRHGLMVFADEIYDQILYDDAVHHSAAALAPDLVVLTFCGLSKTYRVAGFRSGWLVVTGPKQHARSYLEGLTMLASMRLCANAPAQYAIQAALGGRQSIQELTAPGGRLYEQRDRAWQKLNEIPGVSCVKPKGALYAFPRIDPTVHKIHDDEKFVLDLLLREKIQVVQGTGFNWPRPDHFRILTLPHADDLDAAISRIGRFLSGYRQ

SEQ ID NO: 347 - protein, 624 aa, Cryptococcus neoformans var. neoformans
MRGLAKLFFLSCSFVSLVSSEKTDESPTAVSDNYMPKATATIDPSVFALSNDFEITDVPTTREYTFDIAKAFASPDGYEREVYVVNNMFPGPVIEANTGDTIIVHVNNHLDEGQSLHWHGLRQLGTAFMDGVPGITQCPIPPGGSFTYNFTVSHQSGTFWWHSHYSNSMADGIWGPLIVHSTNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISVAPGERYSAIINTNEGKEGDAFWLRTSVALSCMFGAVSQEGLAVVRYTGNGMVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPARRSSSPSIQSSKTSSFQYLREVKGKVVKRRGAREA

SEQ ID NO: 348 - protein, 520 aa, Phlebia radiata
MHTFLRSTALVVAGLSARALASIGPVTDFHIVNAAVSPDGFSRQAVLAEGVFPGPLIAGNKGDNFQINVIDELTNATMLKTTTIHWHGFFQHGTNWADGPAFINQCPIASGDSFLYNFQVPDQAGTFWYHSHLSTQYCDGLRGPFVVYDPADPYLDQYDVDDDSTVITLADWYHTAARLGSPFPAADTTLINGLGRCGEAGCPVSDLAVISVTKGKRYRFRLVSISCDSFFTFSIDGHSLNVIEVDATNHQPLTVDELTIYAGQRYSFILTADQDVDNYWIRANPGIGITTGFAGGINSAILRYDGADVVEPTTTQATSPVVLSESNLAPLTNAAAPGLPEVGGVDLALNFNLTFDGPSLKFQINGVTFVPPTVPVLLQILSGAQSAADLLPSGSVYALPSNATIELSLPAGALGGPHPFHLHGHTFSVVRPAGSTTYNYVNPVQRDVVSIGNTGDNVTIRFDTNNPGPWFLHCHIDWHLEAGFAVVFAEDIPDVASINPVPQDWSNLCPIYNALDASDH

SEQ ID NO: 349 - protein, 624 aa, Cryptococcus neoformans var. neoformans
MRGLAKLFFLSCSFVSLVSSEKTDESPTAVSDNYMPKATATIDPSVFALSNDFEITDVPTTREYTFDIAKAFASPDGYEREVYVVNNMFPGPVIEANTGDTIIVHVNNHLDEGQSLHWHGLRQLGTAFMDGVPGITQCPIPPGGSFTYNFTVSHQSGTFWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISVAPGERYSAIINTNEGKEGDAFWLRTSVALSCMFGAVSQEGLAVVRYTGNGIVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPARRSSSPSIQSSKTSSFQYLREVKGKVVKRRGAREA

SEQ ID NO: 350 - protein, 711 aa, Glycine max
ACVLVSSLLTWFCFVAGLKDDDLYRELWKLCAGPLVDVPRNGDRVFYFPQGHMEQLQASTDQELNQEIPHFNLPAKIFCRVVNIQLLAEQDTDEVYACIALLPESDQTEPTNPDPNVSEAPKQKFHSFCKILTASDTSTHGGFSVLRKHATECLPELDMTQSTPTQELAAKDLHGFEWKFKHIYRGQPRRHLLTTGWSTFVASKRLVAGDAFVFLRGEHGQLRVGVRRLARQQSPMPSSVISSQSMHLGVLATASHAVMTRTMFLVYYKPRTSQFIVGLNKYLEAVNNKFSLSMRFKMRFEGDDSPERRFSGTIVGVGDVSAGWSNSQWRSLKVQWDEPATIPRPDRVSCWEIEPFVASTALNVTQPAVKGKRSRPADVLSSAASGFWYHGSSNELSQLGAAAEVQSKENQVVPCSLRQKDIINSNPINANNSSISTRVRMEGVWPSSPHLNATPNLFSDPNNNNSNNGVSARSLISGYPNVPSRSSDGPTCDGVEDGKKTENSLDCWLFGVNLTNNCSNVITTPSEREQRGPSSSVVLSGPKESIPAAACETERVQTPNYSLSNKGQKQIISEASPNQWQNKQATVLSMRTRTKVQMQGVAVGRAFDLTTLSGYDDLIDELEKLFEIRGELRSQDKWAVTFTDDENDMMLAGDDPWPEFCNMVKRIFICSREDLKKMKCCKLPASSSEVEEILLSPDSQNRDETQQSHMP

SEQ ID NO: 351 - protein, 521 aa, Ashbya gossypii ATCC 10895
MAIGMLRRNSSGTAVSVLQGRVLRTRRLSSVKDGSRFVPAEPMTLADVNENVVKAKYAVRGKIPTRAEELERRLEEHPGSLPFSKIIQANIGNPQQLGQKPLTFYRQVISLMQNPQLLEMPAEWLQQAFKADVVVRARRMLQDAGGSVGAYSASQGVKGYRRTVAQFIERRDGIPANPDNVYLTAGASSAVSCLLSTFCKGPETGVLIPIPQYPLYTATITQNNAVALPYYLNEADGWSTNPDEMERVILDSKKRNIAPKCLVVINPGNPTGSVLSVKDMEAILTLAAKYGIVVIADEVYQDNVFGDAKFHSMRKVLKNLQLREPTLYKNVQLASLHSISKGLSGECGQRGGYMELIGFREELRKVFVKLASISLCPVVTGQALVDLMVGPPSQGDPSYEQYTQETRSIYHELEERSQLLWKTFCSLEGIECNMPQGALYLFPKLHLPQKAIEAAQKLGIPADELYCSELLDETGICTVPGTGFGQIPGTYHVRTTFLPPGTKWIESWKDFHKKFYDKYRD

SEQ ID NO: 352 - protein, 256 aa, Zea mays
  misc_feature (18)..(18): Xaa can be any naturally occurring amino acid
PGRPSVRPDIKEVLQFCXHENLVLLADEVYQQNVFQDERPFISSRKVMFDMGPPLSRELQLVSFHTVSKGNWGECGQRGGYFEMTNLPPKTVDEIYKVASIALSPNVPGQIFMGVMVNPPKPGDISYPKFAAESKSVHESLRRRARMMTDGFNSCRNVVCNFTEGAMYSFPQIRLPPRAIEAAKRAGKAADVFYCLKLLEATGISTVPGSGFGQKEGVFHLRTTILPAEEDFPAIMSSFKKFNDSFMEQYEGYSRM

SEQ ID NO: 353 - protein, 517 aa, Metarhizium anisopliae var. acridum
MTADTSVADGLAPEVHGRLLLLSNRLPITIKSSDDGSYTFSMSSGGLVTGLSGLSKTTSFQWYGWPGLEVPDNEVADMKRRLKDEYGAHPVFIDDELADRHYNGFSDSILWPLFHYHPGEITFDESAWAAYQEVNHLFAQTVIKDVQDGDLIWVHDYPLMLLPQMLREEIAKTNKKVKIGFFLHTPFPSSEVYRILPVREPLLRGLLDCDLIGFHTYDYARHFLSSCSRILGAHTTPNGVDWNGRFVTIGAFPIGIDPDKFVEGLKKPSVQERIATLNRKFEGVKLIVGVDRLDCIKGVPQKLHALEVFLTEHPEWIGKIVLVQVAVPSRQDVEEYQNLRAVVNELVGRINGKFGTIEFMPIHFLHQSASFDELTALYAVSDVCLVSSTRDGMNLVSYEYIATQQERHGVMILSEFTGAAQSLNGSLVVNPWNTEELANAIHDAVTMSPGQRAANYKKLERYVFKYTSAWWGTSFVSEMTRLDSNNAQPKTLRNVSGAVVGPGQDEDEATSPMQNNP

SEQ ID NO: 354 - protein, 664 aa, Aspergillus nidulans FGSC A4
MLRSSFLLFFYALYASASWVFEHDFQPEERSLLFGTDVSPLKRRQEEGSSSASDSILSVAGGGGGRSSGRPQPTSTSFTQTRTTSTRPTSTNTRTGTRSSSNTTTRTSTSATSTPTTTATGTPCAGNTPDTRREWCDYSIDTNYHDITPDTGVVREYWLELDEITVSPDGISRPAVAVNGTIPGPTIFADWGDEVVVHIKNNLHETLNGSTIHWHGIRQLNTNEHDGVVSITQCPITPDHEYTYRWRAQQYGTTWYHSHISLQAWDGVVGPIIINGPATENYDVDAGTIFLNDWTHQTFEELFWYAQIVGPPLLNNSLINGTGVYGSSFSGHRAKGQKETGERFSMKVEEGTSYRLRLINGAIDTHYKFMIDSHELTVIAMDLVPVKPYKTTAVSLAMGQRYDVIVTANQRSKSDSFWLRSIPQQSCSDVEDPGNIRGIFYYGDRPSTPKTEPYPFEDSCMDEPMASLVPHVARDVQPPDYQNNALASVSFNEDHFFRWFLNSTTMQVYWEDPTLLQILNGDDSFENSSAVIELPNANEWVYMIVNTTIPVSHPIHLHGHDFFILAQGTNPWDGKYQTSNPPRRDTAVLPGNGYLVMAWETDNPGAWLMHCHIGWHTTEGFALQFVERIDEIRENVDRDFVVNACNTWNGYGEEYGVEQYDSGV

SEQ ID NO: 355 - protein, 623 aa, Claviceps purpurea
MAALARLTAALAVSMSLAAAATINHDFNVTWVRANPDNAFERPVIGINGQWPIPTIECNVGDRIVINLNNQLGNQSTSLHFHGLYQNGTNQMDGPSGVTQCGVPPGSSITYNFTVDQPGTYWYHSHNDGQYPDGLRGPVVVHDPEFPYSKEIDQEVVLTLSDCYHDEIRDLIPQFLSKTNPTGVSLSNAALSMIAECTVSVQPGKTYHFRVINMGAFAGQYLWFEGHKMRIVEVDGVYTKQAEADMIYLSAAQRVSFLLTTKNDTNANFPFVASMDTSLFDQLPKDLNYNSTGWLSYDQTKTLPDPALVDELNPFDDMTLEAYDGMELLPEPDYNVELNVVMDNLGNGANYAFFNNITYKSPKVPTLYSVLSAGEQAENPAIYGEYTHPFVLKKDEIVQIVVNNLDSGRHPFHLHGHSFQAIYRSNESAGTWEAEGGPSGKTFPKVPMRRDTIVLYPPGNMVLRFKADNPGVWLFHCHIEWHVVSGLMATFIEAPTELQKKVSIPEDHLAVCRAGNVPTEGNAAGNTKDLLDLSGQNAPPDPLPEGFTTRGIVALVFSCITGLLGICVVAWYGMSQPTEEAPKAVAELIREVGENDSETRLGRENGVVGVGAETGAEGLRQRT

SEQ ID NO: 356 - protein, 464 aa, Rhizobium sp. NGR234
MSRLVIVSNRVPVPDKGGIAPAGGLAVALKVALEEQGGGIWMGWSGKSSGEDEPAPLAQLQQGNITYALTDLTDTDVEEYYHGFANRVLWPICHYRLDLAEYGRKEMAGYFRVNRFFAHRLAPLVKPDDVIWVHDYPLIPLAAELRQMGLENRIGFFLHIPWPPADVLFTMPVHEEIMRGLSHYDVVGFQTDHDLENFASCLRREGIGDALGGGRLSAYGRIFKGGVYAIGIETAAFAEFAKKASTNSTVKKARESIERRSLIIGVDRLDYSKGLTQRIEAFERFILANPAQRGRVTYLQITPKSRSEVPEYEAMQRTVAEQAGRVNGALGAVDWVPMRYINRSVGRRVLAGLYRLGKVGLVTPLRDGKNLVAKEYVAAQDPDDPGVLVLSRFAGAARELQGALLVNPYDIEGTANAMARSLSMPLEERQERWTTMMDQLLEHDVSRWCRDFLNDLTASSDRCG

SEQ ID NO: 357 - protein, 623 aa, Fusarium oxysporum
MHFNSLSVEAALLLALPHLASAATRKFDFDIGWVRANPDNAFERPVIGINGKWPIPTIEVDIGDRVIINAHNNLGNQSTSLHFHGLYMNGTTHMDGPAGVSQCPIVPGTSFTYNFTVDQPGTYWYHSHTAAQYPDGLRAPFIVHDKDFPYKDKYDEEVIFTLSDWYHDEMQSMIPKFMSKANPSGAEPVPNNALMNETTNFTMSVKPETTYLFRTINIGAFAGQYLWFEGHKMRIVEVDGIYTEEAEAEMIYISAAQRVSFLLTTKKDTSKNFPIVASMDTTLFDVLPPDLNYNATGWLVYDKQADKPDAATVDTLDPHDDMKLVPYDKMGILGKPDQEFTLDVKMENLKDGANYAWFNNITYVEAKVPTLYTALSAGKDAEDPSVYGTYTHSMVLKKNEIVQIVVNNLDSGRHPFHLHGHAFQSIYRSEEEAGIWADANVTEADLPKTPMRRDTLVIYPNGNIVMRFKADNPGVWLFHCHIEWHVVSGLIATFVEDPLTLQETIQIPKNHLDACAAAGMPTKGNAAANTENFLDLTGENKPAKALPAGFTPRGIVALVFSCICGILGVAVVAWYGFSAPIDPTSAGALSAGIVDGSDSGDGNPAHKGPQETVVSPSGDARSH

SEQ ID NO: 358 - protein, 174 aa, Buchnera aphidicola str. Bp (Baizongia pistaciae)
MESIGIFFGSDTGNTENVAKLIHKYIGTNISSIHDIANTNKKDIELFNILIFGVSTWYYGELQCDWDDFLPTLKKINFNNKIIALFGCGDQEDYSEYFCDGIGILYNVIRLSKNVRFIGSWTSKGYSFECSKALDKNKNFLGLVIDEDRQPEQSNQRIIQWTKKIKTELNSLLN

SEQ ID NO: 359 - protein, 478 aa, Zea mays
MARKPLDYEELNENVKRVQYAVRGELYLRASELQKEGKKIIFTNVGNPHALGQKPLTFPRQVVALCQAPFLLDDPHVGLMFPADAIARAKHYLAMAPGGLGAYSDSRGIPGIRKEVADFIHKRDGYPSDPELIYLTDGASKGVMQILNTIIRNEMDGILVPVPQYPLYSATISLYGGSLVPYYLEEEANWSLDFVNIRQTVAEARSKGISVRAMVMINPGNPTGQCLSEANIKELLQFCYHENLVLLADEVYQQNIYQDERPFISARKVMFDMGPPISSELQVVSFHTVSKGYWGECGQRGGYFEMTNLPPKTVDEIYKVASIALSPNVPGQIFMGVMVNPPKPGDISYLKFAAESKSIHESLRRRARMMTDGFNSCRNVVCNFTEGAMYSFPQIRLPPRAIEAARRAGKSADVFYCLKLLEATGISTVPGSGFGQKEGVFHLRTTILPAEEDFPAIMSSFKKFNDSFMEQYEGYSRL

SEQ ID NO: 360 - protein, 445 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPLADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGVRVIQSSY

SEQ ID NO: 361 - protein, 518 aa, Volvariella volvacea
MQSLLNTLTAMVTVVGWGANFAAAALSSHTLTLTNGFASPDGHSREVVLVNGGLFQAVIAGNKGDDFEIEVDNQLTVEILRKSTSIHWHGLFQRGSAWADGPAFVTQCPIAPGNTFTYEFTPTDEVGTFWYHSHLDAQYCDGLRGPFVIYDPNDPHLALYDVDDEDTIITLADWYHTAAELLTGVVIPDSALINGLGRTSTTTTSPLAVINVVQGTKYRMRLISISCDPNNYIFSIEDHEMTVIEADGISVDPVTVTSLQIFVGQRYSFILHANQPVDNYWIRANPNLGPTGFSGGINSAILRYQGAPVADPTGPGLQDALNRLAETDLHPIVNPGAPDPVDIDLVINIGFSAGLFNIDGTSYVSPDVPSLLQILNGVPVSSLLPSGSYIELPPNKVVQLSFPVIAGQGSAIGAPHPIHLHGHAFDVIRSAGSSTYNLVDPVRRDVVSIGTPGDNVTIRFVTDNAGPWYLHCHIEWHLRAGLGVIFAEDAAGSLLQPAPPTAWGDLCDIYDLLPPEDQ

SEQ ID NO: 362 - protein, 530 aa, Toxicodendron vernicifluum
VDVHNYTFVLQEKNFTKWCSTKSMLVVNGSFPGPTITARKGDTIFVNVINQGKYGITIHWHGVKQPRNPWSDGPEYITQCPIKPGTNFIYEVILSTEEGTIWWHAHSDWTRATVHGALVILPANGTTYPFPPPYQEQTIVLASWFKGDVMEVIISSEETGVFPAAADGFTINGELGDLYNCSKETTYRLSVQPNKTYLLRIVNAVLNEEKFFGIAKHTLTVVAQDASYIKPINTSYIMITPGQTMDVLFTTDQTPSHYYMVASPFHDALDTFANFSTNAIIQYNGSYKAPKSPFVKPLPVYNDIKAADKFTGKLRSLANEKFPVNVPKVNVRRIFMAVSLNIVKCANKSCNNNIGHSTSASLNNISFALPQTDVLQAYYRGVFGRDFPTVQKKANFSLNTAQGTQVLMIEYGEAVEIVYQGTNLGAATSHPMHLHGFNFYLVGTGAGTFNNVTDPPKYNLVDPPELNTINLPRIGWAAIRFVADNPGVWFLHCHFERHTTEGMATVVIVKDGGTTNTSMLPSPAYMPPCS

SEQ ID NO: 363 - protein, 494 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVVPLADATLINGKGRYLGGPAVPLAVINVQQGKRYRFRMISIACDANHHFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHPHGHSFDVVRSADNTTYNYENPVRRDVTSVAIGNQTTIRFVTDNPGPWFLHCHIDLHLEL

SEQ ID NO: 364 - protein, 518 aa, Lentinula edodes
MFYFSSFLLLGPIGGALAAIGPVTDLHIVNSFIQPDGFNRSGVLAEGVFPGPLITGNKGDNFQINVIDELTNGTMLLSTSIHWHGLFQKTTNWADGPAFVNQCPIAANDSFLYNFNVPDQAGTFWYHSHLSTQYCDGLRGPLVVYDPQDPYVDLYDVDDDSTVITLADWYHVPAPQAGAVPTSDATLINGLGRSVNGPADAPFAVVNVVQGSRYRFRLVSISCDPNFLFSIDGHTFTVIEADGVNHEPIVADSIQIFAAQRYSFILTANQTADNYWIRANPNNGHTGFAGGINSAILRYSGAPVADPVTTQTSANLLQETSLVPRENPGAPGNATANGVNVDLNLVLSFVGGRFEINGVSFVPPTVPVLLQILSGATTAAELLPSGSVYTLPLNSVIQLSFNTVAVAAVGGPHPFHLHGHTFDVVRSAGSTEYNYINPPRRDVVSTGAAIDNVTIRFTTDNAGPWFLHCHIDWHLEAGFAIVFAEDAPDVAAVNPVPDAWNQLCPTYDALTPAQLGGN

SEQ ID NO: 365 - protein, 548 aa, Lentinula edodes
MFLINVVFGFWLLCVPTSLRLVSGVEIVKSHPRDNIWHEKTDHHDQLFIVNKDIAPDGFQRSTVLAGRTPQDASFPGPLIAGRKGDRFTINVTDLLTDPTMDRSTSIHWHGLSQKTTNYADGVAFVSQCPIATNHSFLYDFGVPDQAGTLWYHSHLSVQYGDGLRGPIVIYDPEDPHQDLYDVDDESTIITIADWFHLTSLQLLAALVVPNADATLINGNGRYVGGPDTPLTVINVEHGKRYRFRLIDMSFDAFHGFSIDNHNLTIIEVDGINTLPHTVNFIEIYPAQRYSFVLNANRPISNYRIRALSNTGVGAQNFTNGVNSAILRYVGAPEEEPQTSQPLSSDVMIFREGDLHPLENPGAPGNPYPGGADLVLNFTLGFDAEMVLFSMNGVVFESPTVPVLLQILSGAHHAQDLLPKGGVHTLPPNKVIEINFFGGDAPAGPHPFHLHGHAFDVVRTSDSSEYNFKNPVRRDTTLVAMKNQTTIRFVTDNAGPWFLHCHIDLHLSLGLAVVLAEDTRDTKKDDMIPADWKGLCPIYNSLTPSQLP

SEQ ID NO: 366 - protein, 436 aa, Hypsizygus marmoreus
GFFQARTSGMDGPSFVNQCPIPPNTTFLYDFDTAGQTGNFWYHSHLSTQYCDGLRGVFPVYDPKDPLRHLYDVDDASTIITLADWYHGLAPEAQKKFFTSGTVPIPDSSLINGVGRYNGGPLVPFAIVNVVRGKRYRFRVFSLSCRPFFTFSIDNHTFDVMEFDGIEHDPVPAQNFDIYAAQRVSIILNANQTVNNYWIRAFPTGGNPAGNPNFNPALSLAILRYKGAPAVEPTTVNVPGKKLVEGDMHPIREELPGKLGSGPADVAIVLNIAQPNPPFFDINGISYISPPVPVLLQLLSGAQTPQDLLPSEQVFLLPPNKLIEISVPGTGAHPFHLHGHAFDLVRTSNSDVVNYVNPPRRDVAAVNGGNMTFRFFSENPGAWFLHCHIDWHLEAGLAVVFGEAPADNISGPKSQITPKDWQNLCPSYNKLRPEFQ

SEQ ID NO: 367 - protein, 503 aa, Zea mays
  misc_feature (362)..(362): Xaa can be any naturally occurring amino acid
MSYNKAPSITAETINPRVKIIRYAPCGEIVKHAARLEQEIEENPASIPFQEIIYCNLGNPQVLGQPPLTFFREVLSLCDNPALMDRDEARALFSPCSIRRARRILNSIPSKDTGGYTDCRGIKCLRQVVADGITARDGFPSTADDIFLTDGATSAINLMMQILIRSHEDGILSPLPEYPLYSASIILHGGTMVPYNLTEDNGWGLEIFEVKRCLEEARSAGLTVRAMVVINPGNPTGQVLSVTNQEEIVEFCRKEGLVILADEVYQENIYAENKKFHSFKKVARSLAYDENDLTLVSLHSVSMSYGESGRRGGYMEVSGVAANVKDQIYKVASLTLCPNIAGQILVSLAMDPPKNFPCDLYXLGDESFESFDKEKEQIRSSFCKRAKTLEKAFSGLEGVTCNKLEGALYLFPRLHLPSAAIRAADFEGVSPDIFYAHRLLDATGIAVVPGSGFHQASGTIHIRCTILPDERKIEAMVARLRAFHKAFMNEFRGSQQVMNDLRR

SEQ ID NO: 368 - protein, 275 aa, Mesorhizobium loti MAFF303099
MLGFQTATDVTNFRRSVRATGSTTFDINGAAKSNGRTVLSRSFPIGIDVDAFARMANDAASDVQIDSMRRQILGLKQIIGVDRLDYSKGLPGRIQAFARLLERHPEHERTVTYLQIAPPTREEVGAYAEIRAQLEATAGSVNGKYADLTWTPIRYIHRTVPRSRLAGLLRASQVGLVAPLRDGMNLVAKEYIAAQDPADPGVLVLSRFAGAAEELAHSLIVNPYVVDEVADAIAKALGMPLEERIARHGALIERIRRNDAAQWRKSFLEALADSS

SEQ ID NO: 369 - protein, 147 aa, Methanosarcina acetivorans C2A
MEKTIIVYGSSTGNTEILAEEIKGTLEKYDGKVKLMEVTDLHPTDLANYDTILLGCSTWGDGELQDDFIPFEEEMEGVDLKGKKAACFGPGDSTFPLFCNAVDLLEEKLKSCGAQIIVEGLKIDGDVDYQLDKAEEWANEVAQAVSV

SEQ ID NO: 370 - protein, 521 aa, Ganoderma lucidum
  misc_feature (12)..(12): Xaa can be any naturally occurring amino acid
MARLQSFVPDLXLLFAASAYAAIGPVANLTISDADIAPDGFTRAAVVVNGVSPGPLITGNKGDNFQINVINQMTNHTMNKTTSIHWHGLFQEGTNWADGPAFVTQCPIVSGNSFLYNFHVPDQAGTFWYHSHLSTQYCDGLRGPLVVYDPHDPLAHMYDVDDDSTVITLTEWYWTASHLGTRFPAGLANSRDNGLGRTTATSNAELAVVNVTQGKRYRFRLVSMACDPSFNFSIDGHDLTVIEADGVETQPVTVNSINIFAAQRYSFVLTANQTIDNYWIRANPSLGVMGFDAGINSAILRYDGAAPVEPVTSPQSTQILLNETDRPPSLRPEEDAWKPEKGGVDLPLNMAFGFDGTDFFINNATFVPPTVPVLLQILSGTQAAQDLLPAGSVYTLPKNASIEITFPANANAAGSPHPFHLHGHTFAVIRSAGSTAYNYDNPVWRDTVSTGFATNNDNVTIRFQTDNAGPWFLHCHIDFHLNAGFAVVLAEDVPDIARANPVPQAWKNLCPTYDALSPNDQ

SEQ ID NO: 371 - protein, 55 aa, Hordeum vulgare
TFPRQVVALCQAPFLLDDPNVCLIFPADAIARAKHYLSLAPGGLGAYSDSRGIPG

SEQ ID NO: 372 - protein, 537 aa, Oryza sativa Japonica Group
MATGVSVENINPKVILGPSSIAECIVIRGEVAIHAQVSWFSPSMFWKSISIYSFSANARREINRYLTFFFQHLQQQLQTQPGSLPFDEIVYCNIGNPQSLGQKPITFFREVLALCNHPNLLEREEIKSLFSTDAIARAKKILSMIPGRATGAYSHSQGIKGLRDEIAAGIASRDGFPANADDIFLTNGASPGVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEVYQENIYVTNKKINSFKKIARSMGYNGDDLQLVSLHSVSKGYYGECGKRGGYMEVTGFSTPVREQLYKIASVNLCSNITGQILASLIMDPPKAGDASYDLYEEEKDNILKSLSRRAKAMESAFNSIDGITCNKTEGAMYLFPRIYLPQKAIEAARAVNKAPDVFYALRLLDTTGIVVTPGSGFGQIIRCYLFTCNSEFLTTQVWSFVKGCRDMAREMHDPAAGGEDTFDDLPLQGIP

SEQ ID NO: 373 - protein, 365 aa, Mangifera indica
QMGLAENQLCFDLIEDWIRKNPYASICTAEGVDEFKEIANFQDYHGLPEFRKAVAKFMGKVRGGRVTFDPDRIVMGGGVTGANEQIIFCLADPGDAFLVPSPYYPAFDRDLGWRTGGEIVPVPCDSSTNFQITRDALEEAYEKAREANINIKGLIITNPSNPLGITLDRDTLKSLVSFIDEKNIHFVCDEIYAATLFCPPKFVSVAEVIQEMDCNLDLIHIVYSLSKDMGLPGFRVGIVYSYNDAVVSCIRKMSSFGLVSSQTQYLLASMLSDDEFVEKFLAESSKRLAKRYHIFTKRLEKVGINCLKGNAGLFFWMDLRHLLQQETVDAEMKLWGTILNDVKLNVSPGSSFHCQEPGWFRVCFA

SEQ ID NO: 374 - protein, 529 aa, Pleurotus ostreatus
MFPGARILATLTLALHLLHGTHAAIGPTGDMYIVNEDVSPDGFTRSAVVARSDPTTNGTSETLTGVLVQGNKGDNFQLNVLNQLSDTTMLKTTSIHWHGFFQSGSTWADGPAFVNQCPIASGNSFLYDFNVPDQAGTFWYHSHLSTQYCDGLRGPFIVYDPSDPHLSLYDVDNADTIITLEDWYHVVAPQNAVLPTADSTLINGKGRFAGGPTSALAVINVESNKRYRFRLISMSCDPNFTFSIDGHSLQVIEADAVNIVPIVVDSIQIFAGQRYSFVLNANQTVDNYWIRADPNLGSTGFDGDINSAILRYAGATEDDPTTTSSTSTPLEETNLVPPENPGAPGPAVPGGADININLAMAFDVTNFELTINGSPFKAPTAPVLLQILSGATTAASLLPSGSIYSLEASKVVEISIPALAVGGPHPFHLHGHTFDVIRSAGSTTYNFDTPARRDVVNTGTDANDNVTIRFVTDNPGPWFLHCHIDWHLEIGLAVVFAEDVTSITAPPAAWDDLCPIYDALSDSDKGGIA

SEQ ID NO: 375 - protein, 74 aa, Salmonella typhimurium
MNMGLFYGSSTCYTEMAAEKIRDILGPELVTLHNLKDDAPALMEQYDVLILGIPTWDFGEIQEDWEAVWEQLDD

SEQ ID NO: 376 - protein, 404 aa, Vibrio vulnificus CMCP6
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLVPAPDYPLWTAAVALSGGKAVHYLCDEQADWYPDLDDMRKKITPKTRGIVLINPNNPTGAVYSRDFLLEVIEIARQHKLMIFADEIYDKVLYDGAVHTSVATLTDDVLVMTFNGLSKAYRVCGFRGGWMFMTGPKHLAQGYVNGLDMLASMRLCANVPMQHAIQTALGGYQSINELILPGGRLLEQRDRAWELINQIPGVSCVKPKGAMYLFPKIDTKKYSIKDDQKMVFDFLVQEKVLLVQGSGFNWPKPDHFRIVTLPHIEDLETAIGRFERFLHGYSQ

SEQ ID NO: 377 - protein, 405 aa, Enterococcus faecalis V583
MRNFKKSDKLNNVSYDVRGPVLEEAERMQEEGIRILKLNTGNPAPFGFDAPNEIVRDMIVNVRDSEGYSDSKGIFSARKAIEQYCQLKKFPNVTINDIYTGNGVSELITMCMQGLLNNGDEVLVPMPDYPLWTASVSLAGGTPVHYICDEQAEWYPDIDDIKSKITSNTKAIVIINPNNPTGALYPKELLLEIVEVARQNDLIIYSDEIYDRLVMDGLVHVPIATLAPDLFVVTLNGLSKSHRVAGFRCGWMVLSGDKSRVKGYIEGLNMLASMRLCSNVLSQQIIQTALGGYQSVDGLLLPGGRIYEQREFIYNAINDIPGLSAVKPKAAFYIFPKIDTAKFDIYDDEKFVLDFLHKHHILLVHGGGFNWQQPDHFRIVYLPKMEDLKTTADKMREFLSTYKQK

SEQ ID NO: 378 - protein, 762 aa, Chlamydomonas reinhardtii
MERVVSGLDPDAIPSDENVSSSLPTTRVGPAADRLLRERIRRNRSHQAFDVYEDPPPEDPVLETVPEPPLAARLVVVANRLPVTCSKDVPQSSAGGLVSALKGVSNYVTLWIGWPGIWVKAGRERDELTAMLKSEHQIMLGVDRLDMVKGIPQKLLAYEKFLEEHPEWRDKVLLVQIAVPSRTDVPEYQKLRSMVHEIVGRINGQYGTLTYVPIYHLDTSLSFTELCALYAVTDVALVTSLRDGMNLVSYEYVACQSDNAGVLVLSEFAGAAQSLGAGALLVNPWNISDMATAIYDALSMSEDERRERHRQNYMHVQTHTAQHWADTFITELNDTHIEADLRMRHTPPPQVKALAKVNPRVMQSVCELCTDPNNVVVIFSGSETSKLDEVFGHLPVWLAAENGVYPRPPLPQWKCVFDQVHCEWMESVQLVFDYFCERTPRSFVEARETSLVWNYKYADVEFGRIQARDLLQHLWTGPISNAPVEIIQGGKSVEVRPVGVTKGLAMQRLVGIIATEGGIEAAAFDMVLCIGHLLGRDENLFSLFEGARIDGAAPAHNSRAAAAAAAASLQASHTRSSSTGGINLSTVLEVPPGTAAAAAAGGGSGSAQRHAALAAAAAAGGSKVRPGHQCGGGRPAGGHCAAGGAPAQLQSGGAARLRSHRHCQRGGRLPAALARARVRLHTPATTAATTAAATATTAAVPAATRPSAPRLLLQPPAALHRRRRQRRGRRRLGGVAPPPALAAVAPAPAPPPPSQPQPPEQH

SEQ ID NO: 379 - protein, 531 aa, Gemmata obscuriglobus UQM 2246
MGWTKERLQEVARTRLGGAKLIVVANREPYIHRYATDGAVEWIRPAGGLTTALDPVMQACGGVWVAHGSGDADRAVTDPSGRVGVPPDDPNYVLRRVWLTPEQEDGYYYGAANGMLWPLCHQVFARPAFDPGHWDAYRRVNQTFADAVLEEAQGGPALVFIQDYHFALLPRLLKAARPDLVTAQFWHIPWPGPEKFLVCPWARDILDGLLGNDLMGFHTQHDCNHFLECVDRALECRIDRERFAVQRGGQATTVKPFPISVDPALADEYLGDDWAARAGAIRRRHGLGDRPLIVGVDRVDYTKGIPERLRAVDRVLHRHPELKGGFHFVQVGAPSRSSIPAYRDLTAEVNGLAARINREHGTAGWQPVVFLNAHHGPEDIFALYRDAAGCVVSSLHDGMNLVAKEFVTARADDRGVLVLSTFTGAARELTDAVLANPFDVDELADGLYAALTMPAAEQERRMRRMRAQVDDHNIYRWAGSLLTAISKMVPDVADAASEPTVVPDPADESLDATERDIARENYFATLRLAAG

SEQ ID NO: 380 - protein, 244 aa, Arabidopsis thaliana
  misc_feature (178)..(178): Xaa can be any naturally occurring amino acid
RALCQAPFLLDDPNVGMIFPADAIARAKHYLSLTSGGLGAYSDSRGLPGVRKEVAEFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCXMRRRARMMTDGFNSCKNVVCNFTEGAMYSFPQIKLPSKAIQAAKQAGKVPDVFYCLKLLEATGIST

SEQ ID NO: 381 - protein, 414 aa, Mycobacterium avium 104
MHSSAHHRQQRTFAQSSKLQDVLYEIRGPVHQHAARLEAEGHRILKLNIGNPAPFGFEAPDVIMRDMIQALPYAQGYSDSQGILPARRAVVTRYELVDGFPRFDVDDVYLGNGVSELITMTLQALLDNGDEVLIPSPDYPLWTASTSLAGGTPVHYLCDETQGWQPDIADLESKITERTKALVVINPNNPTGAVYSGEILSQMVDLARKHELLLLADEIYDKILYDAAKHINVASLAPDMLCLTFNGLSKAYRVAGYRAGWLAITGPKDHAGSFIEGINLLANMRLCPNVPAQHAIQVALGGHQSIEDLVLPGGRLLEQRDVAWSKLNEIPGVSCVKPAGALYAFPRLDPEVYDITDDEQLVLDLLLQEKILVTQGTGFNWPAPDHLRIVTLPWARDLAAAIERLGNFLVGYRQ

SEQ ID NO: 382 - protein, 425 aa, Xylella fastidiosa Temecula1
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 383 - protein, 520 aa, Trametes versicolor
MSRFHSLLAFVVASLAAVAHAGIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLADWYHVAAKLGPAFPLGADATLINGKGRSPSTTTADLTVISVTPGKRYRFRLVSLSCDPNHTFSIDGHNMTIIETDSINTAPLVVDSIQIFAAQRYSFVLEANQAVDNYWIRANPSFGNVGFTGGINSAILRYDGAAAIEPTTTQTTSTEPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 384 - protein, 395 aa, Silicibacter sp. TM1040
MKTTSITHRLADLGGAKWDLHTAARDRSDRGEDIVEMTIGEPDVALPEPLARAATRAIEAGRTQYSNGRGENGLRDALAESYSARRGRCFERDNVLCFPGTQTALYAVMQGVAETGDEVLVGDPLYATYEGVIRATGADMVPVPLKAEHGFRMQADDIAQRITERTRAILLNTPHNPTGAILRPAELEAIAEIALKHDLWLISDEVYEDLVFDGNSFTSPLTLEQIADRTIAVSSISKSHAAPGMRSGWAIGPRSFMDALLPVSETMLFGNQPFIADVTEEAVRAGSTVAEGMRQRFAKRAQYLADRLEAETVLRVHRPEAGMFALVDVSPLGMDCDAFAWALLENAGVAVMPGSSFGAHLQNWVRLALTVEDAAMTKAVDRISEFARSVAVAAQ

SEQ ID NO: 385 - protein, 467 aa, Propionibacterium acnes KPA171202
MSETVQDKVDFLVIANRLPVDRKVDDDGSVSWKSSPGGLVTALEPVMQRKGGAWIGWHGAPDVVVKPFHHDGYDIHPVPLSAQEVEEYYEGFSNATLWPLYHDCIVEPVFHREWWDAFQKVNKRFAEQAAEQAAEGATVWVQDYQLNLVPKYLREMRPDLRIGFFLHIPFPPIELYSRLPWREELVEGLLGADLIGFQTPGAAANFQRLARHRPGVTAARGRAHTPDGRTVVIRDFPISIDSRGFHELATSEKVKAEAAKLREDLGHPGTIIFGVDRLDYTKGLRQRIRAVGELFKEGKLDPHEVVFLQLATPSRERVEEYKILRDDINLLVGQINSKVGSIANRALVYRNESVPREVLAAMYQMADLMLVTPVRDGMNLVAKEYIACRSNDDSALVLSEFAGAARELKQAYMVNPYDIDGMKATIMKALTDSPKIKARKMRSMRRQVFDKTIDVWADNFLTELEGQ

SEQ ID NO: 386 - protein, 329 aa, Oryza sativa Japonica Group
MMMQLLIRSENDGILCPIPQYPLYSASIALHGGSLVPYFLDEETGWGLEVDELKKQLEEAQSKGITVRALVVINPGNPTGQVLAEENQKKIVEFCKNEGLVLLADEVYQENIYVEDKKFHSFKKIARSMGYTDDDLPLVSFQSVSKGYYGECGKRGGYMEVTGFSADVREQIYKVASVNLCSNVSGQILASLIMNPPKAGDESYESFMVEKDGILSSLARRAKALEEAFNSLEGITCNKAEGAMYLFPRIYLPQKAIGAAQAAGTAPDAYYARRLLEATGIVVVPGSGFGQVPGTWHFRCTILPQEDKIPAIISKFKEFHEKFMDEFRD

SEQ ID NO: 387 - protein, 455 aa, Hyphomonas neptunium ATCC 15444
MGRLVAISNRTAADAGAQAGGLAVAVWDALKATGGLWAGWSGDIVSDSPGSKQFESEDGVSFLLTDMTEDEHDGFYLRYSNSTLWPIFHYRVDLATFDRGAFDHYLAVNERLANLTIEHLREHDMVWVHDYHFLPMADALRRAGWKGRTGFFLHIPFPTPDMFRALPEHSWLARALCQFDLIGFQSESDRTNFERYLVDSLDADASEAPIYTVAGRRVRVGVYPIGIDAAAFEEAARSPAAGDAAARIGRFLGNRDLIIGVDRMDYSKGLPQRFEAVGAFFDNHPELHGKVSVTQIATPSRTKVEEYRQLRYELDQLVGRINGDYGDLDWIPLRYLARSYSRDELAGLFRIARVGLVTPLRDGMNLVAKEYVMAQDPEDPGVLILSEFAGAAEQLHEALIVNPHDRSTLAETIRIALTMPLEERKRRWEALRDVVRRTDIAWWRDLFLNDLRAKI

SEQ ID NO: 388 - protein, 638 aa, Arabidopsis thaliana
MANRGGEYLYDELWKLCAGPLVDVPQAQERVYYFPQGHMEQLEASTQQVDLNTMKPLFVLPPKILCNVMNVSLQAEKDTDEVYAQITLIPVGTEVDEPMSPDPSPPELQRPKVHSFSKVLTASDTSTHGGFSVLRKHATECLPPLDMTQQTPTQELVAEDVHGYQWKFKHIFRGQPRRHLLTTGWSTFVTSKRLVAGDTFVFLRGENGELRVGVRRANLQQSSMPSSVISSHSMHLGVLATARHATQTKTMFIVYYKPRTSQFIISLNKYLEAMSNKFSVGMRFKMRFEGEDSPERRYSGTVIGVKDCSPHWKDSKWRCLEVHWDEPASISRPNKVSPWEIEPFVNSENVPKSVMLKNKRPRQVSEVSALDVGITASNLWSSVLTQPHEFAQSCITSQWSSPQQCHRDANEDAKKSDWLNNSYSVSNVAKDSTLNDQMVSPVEQKKPETTANYRLFGIDLMSSSLAVPEEKTAPMRPINISKPTMDSHSDPKSEISKVSEEKKQEPAEGSPKEVQSKQSSSTRSRTKVQMQGVPVGRAVDLNALKGYNELIDDIEKLFDIKGELRSRNQWEIVFTDDEGDMMLVGDDPWPEFCNMVKRIFIWSKEEVKKMTPGNQLRMLLREVETTLTTTSKTDNHSN

SEQ ID NO: 389 - protein, 595 aa, Auricularia auricula-judae
MAPAQRSKHAHTIVILLVAGVALLALVLGLGLGLGLRNRNKDASAASGATSNLSSQLTAQNGSHAFFIRGAAAMAKDPPQTREYNFTISNVRGAPAGVEKDMVVVNNIWPGPTIEVNQHDRVVIRVMNRAQNATAIHWHGLYQRGTPFYDGTHGITQCGIPPGQDLVYNFTLGDFSGTTWWHSHYMTQYTDGVTGAFIVHPTNATVSAPTYDTDSLIQVGDMYHTISDKLLAAFTSPSGIDGTPGDEPVPDTGTINGMGQYGVNGSQVGTCYKLTLAPNATHRLRIINSGSFADVRFSVDGHPLTVVETDGVEVAPYVVEAVQVSVAQRYSVLLTTNNTAGVYWMRAVVQEDMFTYDQPGFNGNALGVLQYTGVDNSTMPDPGLVDNNPGTGKNLTLMDTALLRPASKQHPPKATLTYKITVSFQVTADNGFFAFINSTSWTPLSGSPTLFSHLGADTVGANTFDNSQLILTSPNSEVIDLIIDNLDDGDHPFHLHGYKFWIMGTGDGRYQGQDVDDVVNPLLRDTHLIPSFTWTVLRFVANNPGAWAFHCHISWHMAIGLLVQFYTMPTEAAGLLLPQDMVDQCSTEGASARVR

SEQ ID NO: 390 - protein, 617 aa, Phanerochaete chrysosporium
MSRDSHGELVVLNEKAAAAKAHATGGRRRALLYGAIAALLLIVALALGLGLGLGLGLKHHRDSTAPASTNSSGQSLPSLQPTPQNNFVLDGLAGQPPQTRSYDFVISQVLGAPDGVSKPMLVVNGMYPGPTIEVNQGDRIVVNVTNLLENRTTIHWHGLFQNQTNYYDGTAGITECGIPPGQSLVYNFTLGDFSGTTWWHAHYSTQYTDGITGALIVHPASPPPVKFPSWDHELVVQVADLYHTFSSILLASYLSPWGIDGTAGDEPVPDAGVLNGLGQWGGGGDYFNFTLEANKTYRIRLVNTGSFASIRFSVDYHTLSVVEADGTLVQPYDVAGVTLAVAQRYSVLLRTDNSTGGPFWMRAAVQSDMFTYDEPGQNLDIRGVIRYGPTANDTALPVETDDPGVPSQPSLQDMDTAQLVPAVVAPAPPSTRQYPLTIALELADSQLFLGFMNGTSWTPLQGTTTLLQARAAFQGGGVYGTEGGSLQSGGQFMVTEDSVQVVDLLISNLDDGDHPFHLHGHRPWIMGTGPGRYIGQPLNATNPLRRDTFLIPAYNWMVIRFITDNPGLWAFHCHLAWHMAAGLLMQINSLPSKAAQLDIPQSIVSQCAATVDGAGAR

SEQ ID NO: 391 - protein, 626 aa, Ashbya gossypii ATCC 10895
MKGLLSSVVLLAAAWTHVSAEEHVFHWKTGMGKANPDTLKERPVITCNGEYPWPAVRVKQGDKVSVLLENGFEKWNTSLHFHGMFQNGTNQMDGPEMVTQCPIPPGGSMWYNFTVEGNKGTFWYHSHTAGQFQDGMKGVFVIDEANSTFAYNFDKEMTLELSEWYHDVAVDKIPEFLHLYNPTGAEPIPQNLIINNTRNLTWKVEPDTTYLLRLVNTGGFVSQYFWIEDHEMEVVEVDGVYVEKNVTNMLYITSAQRYSVLVHTKNETSRNFAIMQKMDDTMLDVMPDDLQLNATSYMIYNDQLPNPEEHRVGELEFLDDIYLVPIDEHRVPMLEDATAKIEVTVDMDNLMDGRNYAFFNNITYTEPKVPTLMTVLSAGDKATNPLVYGTNTNAHVLEHNDIVEIVINNKDTGRHPFHLHGHVFQVVARGPTAADQDDLDAADPIEYPGEDEGREYPMTRDTVYVNGKSYVVLRFKADNPGVWFFHCHLEWHMIQGLSLTIIEAPLEIQRTASQKLTDSTIGACQAAHVPHIGNAAAHTEDLLDLSGQNVQQKSIPEGFTPKGIVAMFFSCLAAVLGLITIAVYGLMDMKDAEGRVIEDLGVDPVVLSKGSLADEGSVSTSSDVKK

SEQ ID NO: 392 - protein, 511 aa, Oryza sativa Japonica Group
MASAMVRAMSTAAAGAAPVSLDTINPKVLKCEYAVRGEIVTHAQDFLRNLDYDLHFILQNLQQELQKNPDSLPFDEILYCNIGNPQSLGQQPVTFFREVLSLCDHPALLDKSETHALYSSDAIERAWQILDKIPGRATGAYSHSQGIKGLRDEIAAGIAARDGFHASGDNIFLTDGASPAVHMMMQLLIRSENDGILCPIPQYPLYSASIALHGGSLVPYFLDEETGWGLEVDELKKQLEEAQSKGITVRALVVINPGNPTGQVLAEENQKKIVEFCKNEGLVLLADEVYQENIYVEDKKFHSFKKIARSMGYTDDDLPLVSFQSVSKGYYGECGKRGGYMEVTGFSADVREQIYKVASVNLCSNVSGQILASLIMNPPKAGDESYESFMVEKDGILSSLARRAKALEEAFNSLEGITCNKAEGAMYLFPRIYLPQKAIGAAQAAGTAPDAYYARRLLEATGIVVVPGSGFGQVPGTWHFRCTILPQEDKIPAIISKFKEFHEKFMDEFRD

SEQ ID NO: 393 - protein, 835 aa, Physcomitrella patens subsp. patens
MVSRSYSNLLDLNEDSTISMVAARRVRPSLNRMLVVAHMLPLNAHPHPSGNSYIFEWDKDSLLWQLKDGLPAGMEVVYVGCLKVEIDGPDQDEVAATLLENFNCVPAFLPEELKSKFYHGFCKQTLWPLFHYLLPLSPEHGGRFNRMWWQAYVSVNKIFADKVMEVISPDDDYVWVHDYHLMALPTFLRKRFNKVKLGFFLHSPFPSSEIYRTLPVRDEILRALLNADLIGFHTFDYARHFLSCCSRMLGLEFVSKRGSIGVEYYGRSVGIKIMPVGIHMGQFDASLKLADTKWRIGEIQEKYKGRIVLLGVDDMDIFKGIGLKFLAMEELLRVHPQWRGQVVMVQIANPARGKGKDIEEAKNEAHAIADRVNEEYGFENYQPIVLVETHVPLFERIAYYTIAECCIVTAVRDGLNLIPYEYIVCREGSPRLAGSENHLNDSSAKKSMLIVSEFIGCSPSLSGAIRVNPWNIEMVAEAMNVAITTKDQEKHLRHEKHYRYVSTHDVAYWAKTYISDLQRTCNDNFKRRCYGIGFGLSFRVVALDPSFKKLRTELIVSAYKRSVRRALLLDYDGTVMPTSHKESPSPEVLDLLNTLCSDPNNVVFIVSGRQRSKLAEWFSSCEKLGLAAEHGYFYSVSEWDRLNLVEREVPIMSFDWKLVVKPVMQLYTESTDGSYIEDKESALVWNHRFADSDFGAWQAKELQDHLESVLANEPVTVKSGAHIVEVTPQGVSKGVVVEKLLYMMEKEHGSLPDMVLCVGDDRSDEDMFESIESLMDHAPSAEVFACTVGQKPSKAKYYLDDVVEVIKMLQGLANASSRPSASSLPQLSDFSSLHI

SEQ ID NO: 394 - protein, 470 aa, Rhodobacter sphaeroides f. sp. denitrificans
MSRLVVVSNRVPLPDENGNPPPGGLAVAVHVALRKNGGIWMGWSGRSTGEEEPQGLTTLEQDKISYVLTDLSQADLDEYYNGFANRVLWPIFHCRLDLAEYARQEMAGYFRVNRLFADRLVPMLEPDDVIWVHDYHLIPLAQELRKRGVRNRIGFFLHIPWPPADIVTALPVYEIIMRGLAAYDLVGFQTDYDLDNFVGCLRREGWGDWSTPGWLRAFDKEVAAAAFPIGIETGDFARLAAKTDGLDLVTDMQQSLHGSALIIGVDRLDYSKGIAARIDAFERYLMRNPDQAGKVTLLQVAPHSRSDVPEYLEMQGQVESHCGRVNGAHGTIEWVPIRYVNQSLTRPVLAGLYRLAKVGLVTPLRDGMNLVAKEYVASQDPADPGVLILSRFAGAARELDGAIFINPYDTEQTAGAIGRALSMPLDERIARWRRMMDHLESHDVLWWCRTFLAALNEAPEDNGALTRESD

SEQ ID NO: 395 - protein, 612 aa, Ashbya gossypii ATCC 10895
MAQRVFFHMVALVLCQLLNLGLVAAKVHRFNFTTGWVTARPDGVAKQVIGFNGQWPLPDIHVDKGDRVELYLTNGFADVGTTLHFHGLFHNSSEGNLAAMDGPDMVTQCGIPPGQTYLYNFSVPTQVGTYWYHSHTGAQYADGMRGAFVVHDPDAQLEYDEEMTHMVGDIYHKPYTQLVHEFLSRYNPTGAEPVPQNLLFNNTVDGSLYFKPNKTYLLRIINGAFFVSQYLYLEGHEFTIVETDGVYVQPNATNLLYLASGQRVSVLVHTKETTDRNFAFMQLFDEDMLDDIPSSLQLNRTNHVIYDDSKPRANPYFLPDYNNPAEEFYLTPLHGKPLYEHYDRQVVLDLHMDNLADGVNYAFFNNITYTTPKVPTLTTALTAGEFASNPLIYGNVNPFVLRYGEIVEIVINNYDDGKHPFHLHGHNFQLVQKSPASISEDGETVRYNESAPVMPYPEFPATRDTVVLEPNGHIVLRFRADNPGVWIFHCHVNWHMEQGLAAVFIEAPHELQAGDPLSDNYRQVCAASNIPNAGNAGGNSANWLDLSDAPRQQDPLPAGFTAKGYFAFALTTLAGLLGLYTITNFGLQKSVIDDAEMYNKLSVLLKENNVLD

SEQ ID NO: 396 - protein, 406 aa, Azoarcus sp. EbN1
MVRKSAKLANVCYDIRGPVLIKAKQMEDEGHKIIKLNIGNLAAFGFDAPEEIQLDMIRNLPNSAGYSESKGIFAARKAVMHYTQQKHIKGVTLEDIYIGNGVSELIVMAMNALLNIGDEVLVPAPDYPLWTAAVSLSGGTPVHYICDEANEWLPDLDDMRARITPNTRAIVVINPNNPTGALYPDHILQGIVDIAREHGLIVYADEVYDKVLYDGATHRSMGSFSEDVLTILFNGLSKNYRSCGYRAGWMVVCGDKRHAQDYIEGLNMLASMRLCANVPGQYAIQTALGGYQSIDDLVAEGGRMRRQRDLAHELISAIPGVSCVKPKATLYMFPKLDPKLYPIEDDQAFIAELLEEERVLLVQGSGFNWPHPDHFRLVFLPHEDDLRDAIGRIARFLEQYRKRHAA

SEQ ID NO: 397 - protein, 573 aa, Boechera divaricarpa
MATWVLHYLLVAFLIAISYNIDAASAGITRHYQFDIQLKNITRLCKTKTIVAVNGKFPGPKVTAREGDNLQIKVVNHVSNNISIHWHGIRQIRSGWADGPSYVTQCPIRTGQSYVYNFTVTGQRGTLWWHAHIQWMRTTVYGPLIILPKLHQPYPFPKPYKQVPIIFGEWFNADPQAVLQQALQTGAGPNASDAHTFNGLPGPLYNCSTKDTYKLMVKPGKTYLLRLINAALNDELFFTIANHTLTVVEADASYVKPFQTNIVLLGPGQTTNVLLKTKPVHPNATFYMLARPYFTGQGTIDNTTVAGILQYQHHSKSSKNLSIIKPSLPPINSTSYAANFTKMFRSLASSTFPANVPKIVDKKYFFTVGLGTNPCPKKQTCQGPTNTTKFAASINNVSFILPNKTSLLQSYFLGKSKSVFMTDFPSAPIFPFNYTGTPPNNTMVSRGTKVVVLKYNTTVELVVQGTSILGIEAHPFHLHGFNFYVVGQGFGNFNSASDPKQYNLVDPVERNTINVPSGGWVAIRFLADNPGVWLMHCHIEIHLSWGLTMAWVVLDGDLPNQKLLPPPSDFPKC

SEQ ID NO: 398 - protein, 148 aa, Bacillus cereus ATCC 10987
MSKLVMIFASMSGNTEEMADHIAGVIRETENEIEVIDIMDSPEASMLEQYDGIILGAYTWGDGDLPDDFLDFYDAMDSIDLTGKKAAVFGSCDSAYPKYGVAVDILIEKLKERGAEVVLEGLKVELTPEDEDVEKCLQFGAEFVKHLS

SEQ ID NO: 399 - protein, 458 aa, Burkholderia vietnamiensis G4
MSRLIIVSNRVAPISEGEPAAGGLAIGVYDALKETGGMWFGWSGEVVASGAPQIRIEERGPVTFATVGLSRRDYDQYYRGFSNATLWPAFHYRADLIQYDRHEFEGYGRVNVWLAQQLVPLLQDDDVIWVHDYHLIPFARALRASGVKNRIGFFLHIPFPAAQVLVNVPPHRELVESLCAFDLLGFQTEPDLRAFCDYVEFEAGGEVTRDGRTVRVSAFGSTLRAAAYPIGVYPDEIASLAQAGEHGKAARMATSLRGRQLIMSVDRLDYSKGLVERFRAFEKLLEHQASIRNRVSFLQIAPSTRADLRAYQDIRLQLEAESGRINGRYAELDWAPILYIHRQYDRQVLAALYRLARVGFVTPLRDGMNLVAKEYVSAQNPDDPGVLVLSRFAGAARELTGALIVNPIDIDGMADALSQALTMPLAERRARYADMIAQLRENNVSVWRDNFLRDLQRA

SEQ ID NO: 400 - protein, 404 aa, Haemophilus influenzae R2866
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 401 - protein, 233 aa, Arabidopsis thaliana
WSPAIRESIAKFLEKRDGHPAEPKDIYLSAGASSGVNTLLHIISDKPTAGVLVPIPQYPLYTATLSVLGSKCVPYYLDESKGWGTDIDAIKGAYKIAEEKGIDVRAIVIINPGNPTGASLSIEDIQAVITFAAENRLVILADEVYQTNVFKGKFYSFKRILRDLQKSNPDKYKYIELASLHSVSKGMVGECGHRGGYFELVGFDPEVQQQIYKFVSITLCAPVIAQCLVELMV

SEQ ID NO: 402 - protein, 481 aa, Arabidopsis thaliana
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVRNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 403 - protein, 496 aa, Yarrowia lipolytica CLIB122
MLRQGIKRAVVHARAVQAVCKRTNMTITKKDLNPQVVNAQYAVRGKLAVRADEIKEQMRTNPSLFPFDKVINANIGNPQQLDQKPVTFYRQVLAMLQYPELMDRAADVGIPNDAVQRARKLLDDIGSVGAYSSSQGVTTVRNSVANFIQKRDGYAASASDIYLTTGASNAVTFLLTTLARGDGSDGFMIPIPQYPLYTATLTLQNSNPVPYYLDEAKEWGTNMAALNDAVESSKHKLKAVVVINPGNPTGACLGVKEIKDILLLAQKEGIAVIADEVYQANIFASGQFHSFKKVWSILKEENPDFNVPLASLHSTSKGKIGECGQRGGYMELVGFHEDVIEQIYKLCSISLCPVVTGQALIECMVNPPVEGDESYPLFNKETNHIMDTLTQRANRLYEAFKEMPKVSCEPPQGAMYLFPSIELPAGAIAEAERHNEQPDEFYCMKLLEQTGICVIPGSGFGQKDGTYHFRTTFLAPGDDYGEKIVNFHKKFLAQYE

SEQ ID NO: 404 - protein, 475 aa, Burkholderia xenovorans LB400
MSRLIVVSNRVAPTQEGRPAAGGLAIGVLDALKETGGVWFGWSGETVSEPSAPVIEKQGNVTYATVGLTKRDYDQYYRGFSNATLWPTFHYRNDLSRYDRQEYAGYQRVNATLAKQLKELLKPDDIIWVHDYHLLPFARCLRELGVKNPIGFFLHIPFPVPEVLRTIPPHEELVKAMCSYDVIGFQTDADRQSFVDFIERGQHGTSSEDGMVHAYNRFLKVGAYPIGIYPDAIAKAAEQFTDRKPVRSLRDGMRGRKLIMSVDRLDYSKGLVERFQAFERLLLNAPGWHGRVSLVQIAPPTRADVQTYQRIRQTLEGEAGRINGRFAQLDWTPIQYLNRKYERNLLMALFRQSQVGYVTPLRDGMNLVAKEYVASQDPADPGVLVLSQFAGAAEQLPGALVVNPFDLSQMAEALERALSMPLAERQARHADMMAPMRENNLSVWRDTFLADLRNVATASSVTAKAVKLADVTASS

SEQ ID NO: 405 - protein, 398 aa, Physcomitrella patens subsp. patens
MDELDCELWHACAGPLTQLPPVDSHVMYWPQGHIEQVCAADVYQASKQFSNLPAHLLCKISKIELQADPHTDEVFAQMDLTPQYETEFTKEMKDAPPPTMQKNVRSFCKTLTASDTSTHGGFSVPRRAAEDCLPLLDHSMNPPCQELVAKDLHGKEWNFRHIYRGHPRRHLLTTGWSVFVSQKRLVAGDTVIFLRGENGQLRVGVRRASKQLPQTRSTHFSNANLHLGVLAAASHAATERLRFSVIYNPRTSPSEFVIPYHKYLKTKENNLTVGSRFKMKFESDESTERRYSGTIVEVSDADPLKWPNSAWRSMKVEWDESASERHERVSPWEIEPFVPISTLPTPSVGPRPKRRPPTFVTDSSPQGTSQSVLDPQQSNKLARILHSHDPRNEVEYRR

SEQ ID NO: 406 - protein, 399 aa, Desulfovibrio vulgaris subsp. vulgaris str. Hildenborough
MSDVFRVSRRVQQIRISATKLMPMLAARVGGCVSLGQGVPSFRTPEHIVEAVCRALRDKADAGRYTLQPGMPALREAIAADLAARKGYMVNPDSEVGVTVGAMEALLMALLTVVDRGDEVIIPSPGYASHAEQVLMAEGVPVHVPLRADDWGLDVDAIRAAVTPRTRAVIVCNPGNPTGTVYDDADVRALCELALERNIMLISDETYDYMVYGGGEPLSPASLPEMRRHVIVVNSFSKKYALTGWRVGYCAADAAWMGELLKVHDAAAICAPAVSQYAALAALTGPQDCVDDMRAALSARRNLACARLDAMAPHFDYVQPRGAFYIMARYTFTDAPSDMVARRLLEEGRVITVPGASFGPTGERHLRLSFGMEEAELDEAFDRMAAWTQRVVASGGLGG

SEQ ID NO: 407 - protein, 397 aa, Symbiobacterium thermophilum IAM 14863
MRLSARARALTPSPTMAIDAMSKQMVAEGIDVVNFSVGEPDFDTPESIKAAGIAAIQQGETKYTPAAGTLELRKAICEKLERDNGLQYRPEEIVVSNGGKQSLYNAYQVLLDPGEEVIIQAPYWVSYPEIVRLAGGVPVVVETDESTGFRLTADMIREKLTNRTRVINLNSPSNPTGAVLSRRELEEIAALAVEHDLMIVTDEIYEKLLYDGAEHVSIASLGEEVKRRTITVNGLSKAYAMTGWRMGYTASERIYAKAMADLQSQSTSGPSSISQAAAVAALRGSQESVEQMRQEFDRRRRHMLERLNRLPGFSVKVAPAGAFYLFPNVSALFGETIAGRKITSSDDLAEVILEQAHVAVVPGTGFGAPHHIRFSYATSMERIDEGLDRIARLLARG

SEQ ID NO: 408 - protein, 944 aa, Schizosaccharomyces pombe
MGRILIAHLFLPSSVGFSFDTVPHDEVGSKFMQKEESKDWIADTPLDESAIVSEEESDDDSLLSDLPEEIDSTNAQSNIATPSPGTVAAAISGIQPPPKTPSSDSPSLENSLSNLNDLFKSRGRHMAFSKNDGTNLSLPPSRHQSPPPSSVLASQRHHRRHDSELEEFARRASRSLSFSMNGTPQRRMTFDAEAWKNVIFKIKPSSFGNASFYNAISAATRSKQFDDHLFVGTCGIPTDSLPDSLKERISHDYITEHSSLVVYPTDTDFVGHYNHYCKNILWPTFHYQIPDNPKSKAYEDHSWANYVKVNKAFADTIVDNYEQDDMIWINDYHLLLVPEMVRERLPRAKIGFFLHIPFPSSEVFRCLATRQEILKGMLGANILGFQIPEFAYHFLQTCSRLVNIDIRKNGVVSFENRQIDVIALPISIDPGFIDRCLASPPVEHWAKVLQDRFRGKHIILSHDKLDPIRGLRSKLISFERFLQKYPEYRENTILLQVAPESLQDSEHLPHISDIVTRINSAYSNIASRHVPVILLRQKLGYAQFLALMMISDALIDNSLREGISLTSHQFIYVQRKRHRPLILSEFVGSASILNDNAIIVNPWDYSKTAEAFRTALTMSEEECQKRNKAMCNLILRHDAASWAVTFQSLIKESWKEQIDMQRIPAFTAQLIKEPYQNAQKRLILLYFEGTISTWGSQYHNVMTSLQRTINLLNMLTSDPKNTVYVFSALSCQELEQLFQRVPKLGIVAENGCFVRSPPKGDATMPVSKKEIAELWKNKVLGTDLTWMKTVSEIFEYYAERTTGAYVENKDATVILHLREAEDDEAAMWAAKECCESVNNFNVPCSATIQNDMVVCRSNKVSKRLAAEDIYSANGGDYDFIFAASNDPDDDTVFSWMKNFKQSKKEVVPFTFSVCVSEHGNSTNADAESSGVFGFLQALEKVYSA

SEQ ID NO: 409 - protein, 488 aa, Kluyveromyces lactis NRRL Y-1140
MVNQDISKLSLNECPGSVIVISNRLPVTIKKDEKTGEYEYSMSSGGLVTALQGLKKSTTFQWYGWPGLEVPDEDKAKVKRELLEKFNAIPIFLSDEVADLHYNGFSNSILWPLFHYHPGEITFDDTAWLAYNEANMAFADEIEGNINDNDVVWVHDYHLMLLPEMIRQRVIAKKLKNIKIGWFLHTPFPSSEIYRILPVRQEILKGVLSCDLIGFHTYDYARHFLSAVQRILNVNTLPNGVEFDGRFVNVGAFPIGIDVETFTEGLKQDAVIKRIKELKESFKGCKIIIGVDRLDYIKGVPQKLHALEVFLGAHPEWIGKVVLVQVAVPSRGDVEEYQYLRSVVNELVGRINGQFGTAEFVPIHFMHRSIPFQELISLYAVSDVCLVSSTRDGMNLVSYEYISCQEEKKGTLILSEFTGAAQSLNGALIVNPWNTDDLAESINEALTVPEEKRAANWEKLYKYISKYTSAFWGENFVHELYRLGSSNN

SEQ ID NO: 410 - protein, 172 aa, Helicobacter pylori
MGKIGIFFGTDSGNAEAIAEKISKAIGNAEVVDVAKASKASIYSFTKVILVAPTAGAGDLQTDWEDFLGTLEASDFANKTIGLVGLGDQDTYSETFAEGIFHIYEKAKAGKVVGQTPTDGYHFEASKAVEGGKFVGLVIDEDNQDDLTDERISKWVRTSLKVLSLDLLSPKF

SEQ ID NO: 411 - protein, 175 aa, Magnetospirillum magnetotacticum MS-1
MMVDGRRTRIRSFPIGIDVAGFKEAADKAGSNKVVRETMAGLRTRKLLIGVDRLDYSKGVPERMEAVDRFFASNPDQRGNVVYIQITPKSRSEVPEYEQLAREVNEKVGDINGMLGEPAWTPIQYVTKAYPRPVLAGLYRAARVGLVTPMRDGMNLVAKEYVVAQSEEDPGVLVL

SEQ ID NO: 412 - protein, 404 aa, Neisseria meningitidis FAM18
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLNDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKSYRVAGFRQGWMVLNGPKHHAKGYIEGLDMLSSMRLCANTPMQHAIQTALGGYQSINEFILPGGRLLEQRNRAWELVSQIPGVSCVKPMGAMYMFPKIDTEMYRIHDDMKFVYDLLVREKVLLVQGTGFNWIKPDHFRIVTLPYVHQIEEAMGRLARFLQTYRQ

SEQ ID NO: 413 - protein, 173 aa, Histophilus somni
MAIVGLFYGSDTGNTENIAKMIQKQLGSELIDIRDIAKSSKEDIESYDFLMIGIPTWYYGEAQCDWDDFFPPRRIDFTDKLVAIFGCGDQEDYAEYFCDAMGTVRNIIEPKGAIIVGHWPTEGYTFEVSQALVDDNTFVGLCIDEDRQPELTAERVEKWVKQVYDEMCLAELA

SEQ ID NO: 414 - protein, 169 aa, Synechococcus sp. CC9605
MTFTIFFATSTGKTEDVADRLKELLPGTEAKDVDNIDSIDELVAAESLICCVPTWNTGADEARSGTAWDDLVQEIPDKDFAGKSVAIVGLGDSSGYSDFFCDAMEELYTAFLQSGAKLIGKVSTEGYTYDDSKSIIDGKFCGLAIDEDNESELTDHRLQAWVQQINAEA

SEQ ID NO: 415 - protein, 434 aa, Methanococcus maripaludis S2
MRTDIVSSGVGELSYEIREIVKVAKKAESSGLEVVWENIGDPIAKGEKLPLWIKEIVSETTMDDSSYGYCPTRGLLETREFLTDLNNSRNGAQITPDEIVFFNGLGDAITNIYGLMRKECRVIGPTPAYSTHSSAEGLYSNCRPVMYELDKDDGWNPDIDDLRNKVKYNPSIASILLINPGNPTGAVYSKKILSEVVDIANEYDLFILADEIYSNLVYNGKKHNYLSEVLDDVPGISLKGISKDLPWPGSRCGWTEFYNTQSDELFKKYTENICKFKMIEVCSTTLPQKVIPKIMSDKRYNKYLEERKSYYETASKYAYNKMKNIDGLNVNRTDGAFYNTIVLEKEYLNENQSLKIQDSELKNYVESISKGIPEDKRFVYYLLASTGICGVPLTSFCSEHNGMRFTLLERDEEKRNWVFETIAEKVEEYFNSSN

SEQ ID NO: 416 - protein, 403 aa, Pseudomonas fluorescens Pf-5
MQVSKSNKLANVCYDIRGPVLKHAKRLEEEGHRILKLNIGNPAPFGFEAPDEILQDVIRNLPTAQGYSDSKGLFSARKAVMQYYQQKQVEGIGIEDIYLGNGVSELIVMAMQALLNNGDEVLVPAPDYPLWTAAVSLAGGNPVHYLCDEQANWWPDLADIKAKITPNTKALVIINPNNPTGAVYPREVLLGMLELARQHNLVVFSDEIYDKILYDDAVHICTASLAPDLLCLTFNGLSKSYRVAGFRSGWVAISGPKQHAQSYIEGIDMLANMRLCANVPSQHAIQTALGGYQSINDLVLPPGRLLEQRNRTWELLNDIPGVSCVKPMGALYAFPRIDPKICPIHNDEKFVLDLLLSEKLLVVQGTAFNWPWPDHFRVVTLPRVDDLEQAIGRIGSFLKSYRQ

SEQ ID NO: 417 - protein, 173 aa, Pseudoalteromonas tunicata D2
MKIGLFYGSTTCYTEMAAEKMRDILGDDILELHNIKDAALKNAEQYDFVIFGISTWDFGELQEDWESKWDDINNVNLAGKTIALFGMGDQQGYGQWFQDALGMLHDQIAPQGVNFIGYWPNSSDYEFEKSKALTPDGSQFVGLALDEDSQYELSDERIATWIEQVLEQYQASL

SEQ ID NO: 418 - protein, 399 aa, Thermococcus kodakarensis KOD1
MIKPSERAMGVEYAIRDVVLPARELEKKGIEVIRLNIGDPGKYDFQPPEHMKEAYCRAIKEGHNYYGPSEGLPEMREAVVQREKRKNGVDITPDDVRVTTAVTEALQLLFGALLDPGDNILVPSPSYPPYTGLVKFYGGIPNEYDTIEENGWQPDIDDMRKRINERTKAIAVINPNNPTGALYEKKTVKEILDLAGEYDIPVISDEIYDLMTYEGEHVSPGSLTKDVPVIVMNGLSKVYFATGWRLGYFYYVDPENKLAEVREAVDKLMRIRICPSTPAQFAAIAGLTGPMDYLEEYMKKLKERRDYIYKRLTEIPGVSTQKPQGAFYIFPRIDERSKWKSDKEFVLDVLHEAHVLFVHGSGFGRAGNWHFRIVFLPPVEILEKAMDRFEEFMRKRLAE

SEQ ID NO: 419 - protein, 561 aa, Frankia sp. CcI3
MDRRTGLSGWPTLRSVRRMPGAEEDTLPRLWPTGTARVLVASNRGPVAFAVGDDGRLRIRRGAGGLVSGLSRVAADNGDGPMAWVCAALSDADRRAARSAPAGRLDLAGHDTDGTAVRMLDVDQVVFDRAYNAVANRTLWFIHHLLYAPASQPVFGPAFRRDWQAYETYNEMFAQALAHEAAPGASVLIQDYHLTLVAARLRALRADLRIAHFSHTPWAPPEYFRILPDDVSEQILRGMLGADRLGFLTDAWADAFQECCRDLLGLRIDRRAVTIGTAGSGRGAGSGRGAGSGRGAGSGREAGSGREAGSGREAGSGREAGRHRTVRIGVHPLGVSADELLGRAAATDVAARAAELVDLAGGRRLIVRVDRTELSKNIVRGLDAYRELLRTRPEWRGKVMHLVCAYPSRHDLPEYREYTAAVQRLAAEIEDEFATDTWLPLRLEITDDYPRSIAALSLAEVLVVNPIRDGMNLVAKEGPIVSTRDAVLVLSREAGACAEMGTAALVVNPFDIQATARALHAALTMPAPERRRRAEELAAVAGRLPPQRWFADQLHALAADR

SEQ ID NO: 420 - protein, 546 aa, Oryza sativa
  misc_feature (310)..(310): Xaa can be any naturally occurring amino acid
MRRFVADRARRAVTSSAASMRAAATRSAAPSAGAAPSAPSPPPPAAAALAMASAMVRAMSTAAAGAAPVSLDTINPKVLKCEYAVRGEIVTHAQNLQQELQKNPDSLPFDEILYCNIGNPQSLGQQPVTFFREVLSLCDHPALLDKSETHALYSSDAIERAWQILDKIPGRATGAYSHSQGIKGLRDEIAAGIAARDGFHASGDNIFLTDGASPAVHMMMQLLIRSENDGILCPIPQYPLYSASIALHGGSLVPYFLDEETGWGLEVDELKKQLEEAQSKGITVRALVVINPGNPTGQVLAEENQKKIVXFCKNEGLVLLADEVYQENIYVEDKKFHSFKKIARSMGYTDDDLPLVSFQSVSKGYYGECGKRGGYMEVTGFSADVREQIYKVASVNLCSNVSGQILASLIMNPPKAGDESYESFMVEKDGILSSLARRAKALEEAFNSLEGITCNKAEGAMYLFPRIYLPQKAIGAAQAAGTAPDAYYARRLLEATGIVVVPGSGFGQVPGTWHFRCTILPQEDKIPAIISKFKEFHEKFMDEFRD

SEQ ID NO: 421 - protein, 405 aa, Lentisphaera araneosa HTCC2155
MKKIGKSSHLESVKYEIRGRVAKASERLRLDGVNVLELNIGNPGVFGFKVPDTMNMALIRNLEKSAAYCASKGIYSAREAIVVDTQNQGVKGLDIDRVYLGNGVSELILMAMEGLLNLDDEVLLPSPDYPLWSAAVKISGGQPVYYPCDSKNDWMPNLEAMEASVTSKTRGLVVINPNNPTGAVYSREILEGIVDIARRHNLIIFSDEIYSKVLYDENEFIPMATLAEDILIVSFNGLSKSYRACGFRCGWMYLTGAVDMAESYLEGLDLLASMRLCSNVPAQWAVQTALGGYQSIFDLCSGGGRLKRQRDLCHKRLNAIEGVSAVNAGGALYLFAEIDLDIYKFSNDEDFVLRFLEEEHVLLVHGSGFNYERSAAFRVVFLPYEEDLQRAFDRLEKFLARHRRK

SEQ ID NO: 422 - protein, 403 aa, Pseudomonas syringae pv. tomato str. DC3000
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAVHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPIFNDEKFVLDLLLSEKLLVVQGTAFNWPYPDHFRVVTLPRVDELEQAIGRIGNFLKGYRQ

SEQ ID NO: 423 - protein, 1030 aa, Pichia angusta
MTILVASLFLPYTVHFEVQVKDKCVNNDTEFDDIAEPIRQPKTSASSKDKQLKDATNTTISLIKALAKNSSASNLSQTDLIDNRIQVISEDDDGETSVSTSNTDGANQNVSVQEFFFNNPKQPTLDEISQLKEASKSSPSVNVSTSTFIQPKSRVSTTKITVSSSVSEKQATKGPELLHSSLKVNRPGLSSRRSSSKVAKQALEKPLEREKDEYPPEHENAFLPDEDKVTPFGGFSKPDYHDLFIKDNVFATAPWRVVEFDKANGSLKNAIRVAAASDPETKFRWVGVLPIPSDVVPQTTKNNIAKELSEKYDSSVAFVDDVTFHGHYTSFSKEILWPIFHYQIPDNPKSNAFENHSWKHYEKLNRAVADQIVSQYREGDIVWVHDYHLMLVPKMIREKIPNAKIGFFLHVSFPSSEVFRCLAQRNNILEGLLGADCIAFQTEEYVRHFYQTCNRLLLADFDEYGIRYKDRVISVRGNPIGVDAELLNKRLQNNLCLNWRTLVRERWADKKLIVSRDKIDRIRGIKEKLLAYERFLNDNPERVSDTILILIYTKAKMEKDDDFETSIFNIAERINAKSSNISTDQPVIFLHQDIEFEQYLALLAEADLFIISTLREGMNLTSQEFVVAAQETHSPLIMSEFVGSAQVMTEGPLLTNPYDVKQVAENIKLGLEMSPEEKLQRWKKMYATILKHDSQSWVKNCIHDIETAFASNRKDCSSELTQLSQALFKEKYHSLPHPESKRLFIINLGNLVSKVNIPGSLINPVQHEYIMSTLFNLANDPNNIVYVFSFLKRSDLLRRYRRIGELGLIAENGGYIKLPNSNDWFTVIDENELTWMPTVIEVMNALCERLPGSFVEVEECTVRFHTENCSDVDRDHKLKLVGELITHVNELYSKEFNLHANLINGIVIVQEANLIVRALSFVMNQNSFDGHLRKIPSSSLTSPVSQPSDLTMSFKNQPQLKHNLGFVMAAGGNTPVDEEVFNYFNSLEFDIENKFTIRVGQDNSNSKAEEKLSGVNELFRILSTVIASDK

SEQ ID NO: 424 - protein, 481 aa, Arabidopsis thaliana
MSLKALDYESLNENVKNCQYAVRGELYLRASELQKEGKKIIFTNVGNPHALGQKPLTFPRQVVSLCQAPFLLDDPNVGMIFPADAIARAKHYLSLTSGGLGAYSDSRGLPGVRKEVAEFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCCDERLVLLGDEVYQQNIYQDERPFISSKKVLMDMGAPISKEVQLISFHTVSKGYWGECGQRGGYFEMTNIPPRTVEEIYKVASIALSPNVSAQIFMGLMVSPPKPGDISYDQFVRESKGILESLRRRARMMTDGFNSCKNVVCNFTEGAMYSFPQIKLPSKAIQAAKQAGKVPDVFYCLKLLEATGISTVPGSGFGQKEGVFHLRTTILPAEEEMPEIMDSFKKFNDEFMSQYADNFGYSRM

SEQ ID NO: 425 - protein, 559 aa, Oryza sativa
MVIPWCSSMMRLLWFLFALLLARSVADAATANYTFTVESMRVSRLCNSTDIIAVNGLLPGPMIEVNEGDAVAVEVINGSPYNLTIHWHGILQLLTPWADGPSMVTQCPIQPNSSYTYRFNVTGQEGTLWWHAHSSFLRATVYGALIIRPRNGSAYPFPAPDQEVPIVLGEWWSRNVVDIESDAVSSGQLPRESDAFTVNGVTGELYQCANDTFTVDVQPNTTVLLRVINAGLNTHLFFKVAGHAFTVVAVDACYTANYTTDTLVLAPGHTVDALMVTNASAGSYYMAVQAYDSLSPTTMAVTDDTTATAIVHYNTTSTKKNATPVMPTMPQSSDSATANAFYFGLRGPPSPSAPAVPTKVDVNMTIELGLGQLPCDSTQSSCSGKSVAAAMNGVSFRLPSQMSLLEAQFNRTPGVYTADFPDAPQPSGTPMVEGTKVRRLKYNSTVEIVLQNPTAFPSENHPIHLHGFNFFVLAQGLGNFTPGNVSGYNLVDPVSRNTLAVPTGGWAVIRFVANNPGMWFFHCHLDAHVPMGLGMVFAVDNGTTPDSFLPPPPADLPKC

SEQ ID NO: 426 - protein, 620 aa, Candida albicans SC5314
MIFNQFILWLISIPLILASGTIHRFDWNVSYVMANPDGIHPRRMIGINNQWPNPTIRSKKNDRVIINLTNELPDKNVSLHFHGLFQRGYNDQDGPAFVTQCPISPGVTFTYDFNVTDQSGTYWYHSHMGSQYGDGLRGLFIIEYDNDDEYNKEFPYEYDEDVTLSVGDHYHLESPEIVKNFMTRFNPTGAEPIPQNGLFNETKNVTWQVNPDTTYLLRIVNMGLFTSHYVYIEDHTFTIVEVDGVVVEPYETDSLYVAVAQRYVVLMKTKKSADKNFRFVNVLDQDMLDFLPSDLQIVSTNWIVYDKSLELPPALPFNQFHKTIKSLVGFDDFDLRPLRKVNLLDEPDYTIQVNLTMEVLGDGVTYAMFNGKTFRPPKVPSLYTVLSTHGNTNLTTNELIYGTNTNSFVLQGDEVVEIILNNMDPGKHPFHLHGHNFQVISRFDTDDEDNQLVFDPTNETYTNYPEFPMVRDTVEVGPNGFIVLRFKADNPGVWFFHCHVDWHLEQGLAILLVEDPLELLSSNTTIPQNHIDACNAIGMPIKGNAAGNDIDLLDLYGENIQPNPLPAGFTNKGYLAITCCTLIAIYGLWSIYNYGMEDISKDNAEDVIEKLYKILDDYDK

SEQ ID NO: 427 - protein, 460 aa, Burkholderia xenovorans LB400
MSRLVVVSNRTVDPRKTAAGGLAVAVRESLQRTGGLWFGWSGKIYDESDEMTSRRGVHVQTLGNVTLATVDLSQQDHDNYYLGYANGVLWPVFHYRLDLADFDTRFAAGYRRVNQLFAEKLLPLLRPDDIIWVHDYHLIPLAAELRAIGCGNRIGFFLHIPMPPPMIMAAIPEHEWLMRSLFAYDLVGFQGQIDVEHFTHYAESEANARQVGPQQLRAFNRTLRLGAYPIGIDVEEFVSLANGKEAREMFTRMRDEYSRRRLLLGVDRLDYSKGLPQRIHAFRELLAHYPENRDSATLIQIASPSRESVAAYDDLRRQMDSLCGAINGDYGELDWMPVRYIHRHVARKRLPGLYRASKVALVTPLRDGMNLVAKEFIAAQDPSDPGMLVLSRFAGAAEQLKEALLVNPYDTQGTAHAIQRALTMPLDERRNRHAALMKRIREHDVHWWSSSFLDTLQDIP

SEQ ID NO: 428 - protein, 942 aa, Arabidopsis thaliana
MPGNKYNCSSSHIPLSRTERLLRDRELREKRKSNRARNPNDVAGSSENSENDLRLEGDSSRQYVEQYLEGAAAAMAHDDACERQEVRPYNRQRLLVVANRLPVSAVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVIQHMKELKERFAGRKVMLGVDRLDMIKGIPQKILAFEKFLEENANWRDKVVLLQIAVPTRTDVPEYQKLTSQVHEIVGRINGRFGTLTAVPIHHLDRSLDFHALCALYAVTDVALVTSLRDGMNLVSYEFVACQEAKKGVLILSEFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSP

SEQ ID NO: 429 - protein, 518 aa, Oryza sativa Indica Group
MAAPSVAVDNLNPKVVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQGTYVFLFVCNVHEAFAAGAGTQQKNCNHVLIHLQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 430 - protein, 431 aa, Arabidopsis thaliana
MRRFLINQAKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILSPIPQYPLYSASIALHGGSLVPYYLDEATGWGLEISDLKKQLEEARSKGISVRALVVINPGNPTGQVLAEENQRDIVNFCKQEGLVLLADEVYQENVYVPDKKFHSFKKVARSLGYGEKDISLVSFQSVSKGYYGECGKRGGYMEVTGFTSDVREQIYKMASVNLCSNISGQILASLVMSPPKKEMEFSHPWLNVQRLWKTLSTV

SEQ ID NO: 431 - protein, 567 aa, Castanea mollissima
MGSTKTSLILGFLGFLFLDSLLFCSAYNVHHYSFLLRETNFTRLCTTKSMFTVNGQWPGPTIHVRKGDKAFVNVHNNGDYGVTIHWHGVKQPKNPWSDGPENITQCPIKPGKNFTYEVIFSDEEGTLWWHAHSDWSRATIHGAIVILPEIGKTYPFPKPYAEQVLILAEWFNGDVKELIDEATSTGGDPTPSNAYALNGQPGFPNNCSNETTFRFPVQYGKTYLLRLVNAGMNEEMFFGIAKHNITVVAQDAAYIKPITTSYIMITPGQTMDILVTANQAPSYYYIAASPFFDSSAPYDTTNTSAILQYTGTYTIPTTIPYPTLPNVTDKAAADNFTTRIRSLASAEHPVYVPKNVTTRIFITVSVNQIVCANASCGGPSGNRLSASLNNISFVTPSTDVLQAYYKSLPNVFDKDFPNLPPYKFNFTGDVGNNTLYPSLGTKAKLINYGDVVEIVYQGTNVGNAENHPMHLHGFSFYLVGTGYGNFDLTNSTKTYNLIDPPEVNTIGVPKNGWAAIRFVANNPGVWFMHCHLERHASWGMDTVLIVKNGPTKETSIRPPPANLPICS

SEQ ID NO: 432 - protein, 479 aa, Oryza sativa Indica Group
MLRAAARALTVSSLNPKVLALADHHLGGLVARRAQLVTVTVNILIVERKKILQADTSMQQELDANPASHPFSEVLALCNHPHLLDRSEASFMFSSDAITRAREIVGFIPGKTTGGYSHCQANSIVSEFRANADKYGNELSSNLTIFDRVHMMMHLLIRGKKDGILCPIPSHSLYTDSMVLRGATLVPYYLDESRGWSVNISDLKKQLDGARAKGIAVRGLVVVNPGNPTGQVLVEENQCEIVELCKNECLVLLADEVYQENIYTDQKKFNSFKKVARSIGYGEGDISLVSFHSVSNGYYGECGRRGGYMEVTGFSSEVRGEVYKVASLSACSNISGQILMSLVMNPPKVGDESYPSYRAERDSILSSLSCCAEAMVSTFNSMEGMTCNKAEGGISVFPSVRLPPRAIEAAEAMNTEPDVFYALRLLESTGIVVVPGSVFGQVPGTWHFRCTILPQEEKTRQIISRFNVFHEAFMEEFRS

SEQ ID NO: 433 - protein, 1014 aa, Ostreococcus tauri
MPADGSTPESPPRRSRAFADVPDAATPFTSPRRRSVDASASPIRHVDSEIFARASRASMSSLNAMSTDGSMYDLTRRMEGLAGSAVFDAQGQQSEELESTRVDRLLRERAEQLKRTRSQTNLVSGEIAEESAVFEEEEPVRESLIIAANRLPVSVKRKADGTWDVRPSAGGLVSALLGVRKTYGMTWIGWPGIFIEPGPERDSLTATLRRQNLLPVYLTKSQVELYYNGYCNNVLWSLFHYVPLNFEARLNQETNMTAQWVAYKEANRVFADAIMSVYRDGDIVWAHDYHLMLVPEMLRQDVETMKIGWFLHTPFPSSEIYRMLPMREALLHGCLAADLVGFHTYDYARHFVSATSRILGLEATPDGVETQGGFTRVAAFPIGIDPSRFTAALRTDQVQDHIKELQERFRGRKVMLGVDRLDMIKGIPHKLLAFEKFLIENPEWKDKCCLIQIAVPTRSEVPEYQKLASTVHEIVGRINGRFGSIGSIPIQHLDCSMQFPELCALYSVTDVMLVTSQRDGMNLVSYEFVSCQNKSNAGVLVLSEFAGAAQSIGAGALLVNPHNVTEVAHAIKEALTMPEAEKIERHRSSFSHVSTHTAQAWADTFISELNDTHVEAELRQKRIPPHLSPDVVTRSFQKGKQRLIILGYNATLTDPMDSRSKNRPAIESKKNRHKIHPISQECISRLCDDPNTTVCIFSGSDRNKLAQIFAMLPKVWIAAENGVFIRPPLQGKNGTETPKWMTMIETTNLDWLESVEVVFEYFCERTPRSHVETRETSLVWSYKYADPDFGRQQARDLLQHLWTGPISNAPVDVVMGAKSVEVRPVGLSKGTAVERILHIINGGKNKELIEVDFVACFGHFLGRDEDIFSFLEQNSSQNSLSTNAHSPGSKKGNTSLSASIQNDLAAVEEHDESNLKKKHEAEIRFQDIVTCTVGRKRSSARYFVNDSDEVALCLAALTNSLNDGKGVIELLQFEDSISNVSKSASRGNLSTGRAASLPGGDNDAVYRSSSGQSI

SEQ ID NO: 434 - protein, 534 aa, Saccharomyces cerevisiae
ETHTFNWTTGWDYRNVDGLKSRPVITCNGQFPWPDITVNKGDRVQIYLTNGMNNTNTSMHFHGLFQNGTASMDGVPFLTQCPIAPGSTMLYNFTVDYNVGTYWYHSHTDGQYEDGMKGLFIIKDDSFPYDYDEELSLSLSEWYHDLVTDLTKSFMSVYNPTGAEPIPQNLIVNNTMNLTWEVQPDTTYLLRIVNVGGFVSQYFWIEDHEMTVVEIDGITTEKNVTDMLYITVAQRYTVLVHTKNDTDKNFAIMQKFDDTMLDVIPSDLQLNATSYMVYNKTAALPTQNYVDSIDNFLDDFYLQPYEKEAIYGEPDHVITVDVVMDNLKNGVNYAFFNNITYTAPKVPTLMTVLSSGDQANNSEIYGSNTHTFILEKDEIVEIVLNNQDTGTHPFHLHGHAFQTIQRDRTYDDALGEVPHSFDPDNHPAFPEYPMRRDTLYVRPQSNFVIRFKADNPGVWFFHCHIEWHLLQGLGLVLVEDPFGIQDAHSQQLSENHLEVCQSCSVATEGNAAANTLDLTDLTGENVQHAFIPTG

SEQ ID NO: 435 - protein, 174 aa, Colwellia psychrerythraea 34H
MAIVGLFFGSDTGNTEAIGKMIQKKLGKQMVDVKDIAKSTKEEIAEFDLLILGIPTWYYGENQCDWDDFLPDLEAIDFTDKLVAIFGLGDQEDYAEYFCDAMEPLRDIVESKGAIVVGNWSTDGYEFEASKALVDENTFIGLCIDEDRQSELTEARVDKWLAQLNDEMCLAEFA

SEQ ID NO: 436 - protein, 521 aa, Phlebia radiata
MRFTALAATLLSSLLSEVYATNSGIGPVTDLRISNAVVSPDGFSRDAVVVQGQFPSPLIKGNKGDMFKLNVINQLQDTALNTSTSIHWHGLFQHGTNWADGPAFVTQCPIVTGDSFVYDFTVPDQAGTFWYHSHLALQYCDGLRGPLVVYDPHDPYAHLYDVDDESTVITLAEWYHTAADNLRPPEEANSTLINGLGRYAGGPASPLSVITVEHGKRYRFRLVSMACDPSYNFTIDGHNMTVIEVDGVNHLPLTVDKIQIFVAQRYSFILDANQPIGNYWIHAIPNGQSQLVGVANGINSAILRYVGAPNKEPTTQTPPSVAPLQEVNLHPLVNAAAPGKPFPGGADQVIPFNLSLLGANFLINNATFSPPTVPVLLQILSGAKTPQQLLPPGSIYSLKRNSVIEIVIPPGTAPGGPHPFHLHGHTFSVVRSAGSSVYNFKNPVQRDVVSIGTGANDSVTIRFVTDNPGPWFIHCHIDFHLNAGLAAVMAEDIPDIKLANPVPAEWEQLCPIYDQKVLHEH

SEQ ID NO: 437 - protein, 163 aa, Campylobacter coli RM2228
MSVAVIYGSAMGNTEGAANTIASKLGISDVLNVADIDAAKINSYDKLICGTSTWGSGDLQDDWDGFDFSGLSLGGKTVAVFGMGDSESYSDTFCGGMGKLAENLKNAGANLVGEVSTDGYTFESSDAVVDGKFVGLALDNDNQEDQTEARIDAWVEQIKAHFA

SEQ ID NO: 438 - protein, 174 aa, Actinobacillus pleuropneumoniae serovar 1 str. 4074
MAVVGLFYGSDTGNTENIAKMIQKEIGANLIDVRDIAKSAKEDIEAYDFLLLGIPTWYYGESQADWDDFMPTLKEIDFSGKVIGIFGCGDQEDYAEYFCDAMGTIRDVVEQNGGVIVGHWPTEGYSFEVSQALVDENTFVGLCIDEDRQPELTGERVNRWCKQIFDEMCLDQLA

SEQ ID NO: 439 - protein, 420 aa, Oryza sativa
MSSDEREKRHRHNYAHVTTHTAQDWAETFVCELNETVAEAQLRTRQVPPDLPSQAAIQQYLHSKNRLLILGFNSTLTEPVESSGRRGGDQIKEMELKLHPELKGPLRALCEDEHTTVIVLSGSDRSVLDENFGEFNMWLAAEHGMFLRPTNGEWMTTMPEHLNMDWVDSVKNVFEYFTERTPRSHFEHRETSFVWNYKYADVEFGRLQARDMLQHLWTGPISNAAVDVVQGSRSVEVRSVGVTKGAAIDRILGEIVHSKSMITPIDYVLCIGHFLGKDEDIYVFFDPEYPSESKVKPDSSGSVSLDRRPNGRPSNGRSNSRNSQSRTPKAQAAPERSSSSSSSSQGTPNSHHDWREGSSVLDLKGENYFSCAVGRKRSNARYLLNSSEEVVSFLKEMADATAAHNGFQSTTADYMFLDRQ

SEQ ID NO: 440 - protein, 481 aa, Fulvimarina pelagi HTCC2506
MADSNPRLVAVSNRVGPLSDEGQAGGLVVGLSDALKRRGGVWFGWSGETSKEGTQGEAKTEVQENVEMTTIDMSQEELQGFYYDYANRSLWPLLHYRLDLAEFDRVSDKVYRQVNHRFAVRLMPHLKENDLVWVHDYHFFYMGSELRQAGYKGRLGYFLHIPFCAPEVFSALPASHDIVRALLAYDVIGFQTDTDRCNFVSFCISELGGEKLDEDRVRVGDRTVIAKPFPIGIDAEGYARFAVSPEAGEHEEMLLSMTRDRRNSDGEGAERKLIVGVDRMDYSKGLLERFYGFERLLEDYPENCGSAIFLQVAPLSRSELDAYAELRDELERTAGHLNGRFATLDWTPLQMMTRGFTRKALAGIYRAARVCLVTPLRDGMNLVAKEFVAAQDPEDPGVLILSRFAGALDELKCGCIVVNPYNTDDVAAAMQRALTMPLEERKRRWEAMREAVFTGTAQRWCQSFIDMLETSHHEPAAQTSS

SEQ ID NO: 441 - protein, 173 aa, Prochlorococcus marinus subsp. marinus str. CCMP1375
MTVGIYFATTTGKTEDIAERIHGLLDGAESPKDMSDVDDLSELSNHDGIICGIPTWNTGADSERSGTAWDTILDEIGELNLTGKKVAIFGLGDSSTYTENYCDAMEELHRYFQQAGATMVGYVSTNDYTFDESKSVVGSTFCGLPLDEDSESDMTDARISQWATQLKGEMPGL

SEQ ID NO: 442 - protein, 429 aa, Methylobacillus flagellatus KT
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLCANVPGQLAIQTALGGYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEGKASKEAQTTSQSASA

SEQ ID NO: 443 - protein, 404 aa, Streptococcus pneumoniae TIGR4
MKEYNKSSKLEHVAYDIRGPVLEEAMRMRANGEKILRLNTGNPAEFGFTAPDEVIHDLIMNARDSEGYSDSKGIFSARKAIMQYCQLKKFPNVDTDDIYLGNGVSELIVMSMQGLLDNGDEVLVPMPDYPLWTAAVSLAGGNAVHYICDEAVEWYPDIDDIKSKITSNTKAIVLINPNNPTGALYPKELLLEIIEIARQNDLIIFADEIYDRMVMDGHVHTPVASLAPDVFCVSMNGLSKSHRIAGFRVGWMVLSGPKTHVKGYIEGLNMLSNMRLCSNVLAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 444 - protein, 557 aa, Saccharum hybrid cultivar
RTRGLEENPDWNNKVVLLQIAVPTRTDVPEYQKLTSQVHEIVGRINGRFGTLTAVPIHHLDRSLDFHALCALYAVTDVALVTSLRDGMNLVSYEYVACQGSKKGVLILSEFAGAAQSLGAGAILVNPWNITEGADSIRHALTMPSDEREKRHRHNYAHVTTHTAQDWAETFVFELNDTVAEALLRTRQVPPGLPSQMAIQQYLRSKNRLLILGFNSTLTEPVESSGRRGGDQIKEMELKLHPDLKGPLRALCEDEHTTVIVLSGSDRSVLDENFGEFKMWLAAEHGMFLRPTYGEWMTTMPEHLNMDWVDSVKHVFEYFTERTPRSHFEHRETSFVWNYKYADVEFGRLQARDMLQHLWTGPISNAAVDVVQGSRSVEVRSVGVTKGAAIDRILGEIFHSENMVTPIDYVLCIGHFLGKDEDIYVFFDPEYPSESKIKPEGGSASLDRRPNGRSPSNGRSSSRNPQSRTQKAQQAASERSSSSSHSSASSNHDWREGSSVLDLKGENYFSCAVGRKRSNARYLLSSSEEVVSFLKELASATAGFQSSCADYMFMDRQ

SEQ ID NO: 445 - protein, 389 aa, Saccharum hybrid cultivar
SRSRLLRNVETTAEALNEAISMSEQEKQLRHGKHYRYVSTHDVAYWSKSFVQDLERACKDHFRKPCWGIGLGFGFRVVALDPHFTKLNLDTIIMSYERAKSRVILLDYDGTLVPQTSIDKKPSSEILRIINTLCSDSNNTVFIVSGRSRDSLGSLFASCPKLGIAAEHGYFLRWTRDEGWQSSTHTSDFGWMQMAEPVMNLYTESTDGSYIETKETALVWHHQDADPGFGSTQAKEMLDHLESVLANEPVAVKSGQFIVEVKPQGVSKGLVAEKILTLMKEKGQQADFVLCIGDDRSDEDMFENIADVIKRNVVAPKTPLFACTVGQKPSKARFYLDDTLEVGNMLSLLADASEPDPVIELEDDLATSVSAIDISDEPPQLGHRREEGS

SEQ ID NO: 446 - protein, 753 aa, Azoarcus sp. EbN1
MLIATDLDGTFLAGHPEARLRLYQLINAHPEIKLVFVTGRGLEVVLPLLSDPSIPTPDYIVCDVGATVVDGRTLQPVQPLQAGIDALWPGERVVAAAMASFVGIERQEVPQQRRCSYFCAPGTVGSDLRGIAAELGCDMLYSAERYLDILPRGVNKGSTLDALVRLLEIDRDAVLVAGDTLNDLSMYERGFVGVCVGESEAALLDATRERAHVLHARHPGCGGILEAIAHFGFLGPAGVEAELRETDTPGRSELVMVYHRLPYEEVFENGRITRAAPSSPNGIIPTLLSYFSDGRPGAWIAWSMHDPKKAIPFEVHTTVDRERYPHLVAARVPLTKDDIDIFYKRFSKEAFWPTLHTFWERAQFREDDWHVYLKVNRLFAERAAAEAAEGAVVWLHDYNLWMVPAVLRELRPDVKIAFFHHTYFPSADVFNVLPWRREIIGSLLQCDYIGFHIPRQAENFVDVARGVAPLTVLERRNCAPRYLTYGCAVGLDEVTTAIEVHGRRIGLGAHPVGLDVERVRKILDQPSTRKRMAELRADLVDTRVILSVERLDYTKGTLEKLLAFERLLDAHPELQGKVSLMAVCVPAAKEMTIYDALQTQIEQAVGRINGRFSRVSWTPVQFFFRALPFEEVVAWYAMADVMWITPLRDGLNLVAKEYVATQGMIEGRGVLVLSEFAGAAAELHGAVLTNPHDLADLAARLYQAIAMNDAEAEARLRELFAIVEHNDIHRWGRNFLEAVTTPVGEDSLAGTGC

SEQ ID NO: 447 - protein, 259 aa, Zea mays
MARKPLDYEELNENVKRVQYAVRGELYLRASELQKEGKKIIFTNVGNPHALGQKPLTFPRQVVALCQAPFLLDDPHVGLMFPADAIARAKHYLAMAPGGLGAYSDSRGIPGIRKEVADFIHKRDGYPSDPELIYLTDGASKGVMQILNTIIRNEMDGILVPVPQYPLYSATISLYGGSLVPYYLEEEANWSLDFVNIRQTVAEARSKGISVMFDMGPPISSELQVVSFHTVSKGYWGECGQRGGYFEMTNLPPKLRFFL

SEQ ID NO: 448 - protein, 488 aa, Ipomoea nil
MDLKSMRQQTQILSKIATNDGHGENSAYFDGWKAYDNNPFHPKHNPQGVIQMGLAENQLCFDLIKNWVLNNPKASICTPQGAEEFKDIAIYQDYHGLPEFRTAVARFMEKVRGDTVKFDPDRIVMSGGATGAHEILAFCLVDPGEAFLVPTPYYPGFDRDLRWRTGVQLYPVVCESSNDFKVTRTALESAYKKAQEDNIRVKGLLINNPSNPLGTVLDRDTLHDIVRFVNDKNIHLVCDEIYAATVFSQPEFISIAQIIQEVQCNPDRIHIVYSLSKDLGFPGFRVGIIYSYNDAVVSCARKMSSFGLVSTQTQHLIAAMLSDKEFVENFILESSERLRKRHESFTRGLAQVGIETLKSNGGLFVWMNLRNLLKEPTFAAELELWKMIINEMKLNVSPGCSFHCQEAGWFRVCFANMDDETMRVALMRIRTSVLQWKGMEAAAAASAKKQKQCRRNLKVSLSFRRGLEDCMISSPHSPMNSPLVQATN

SEQ ID NO: 449 - protein, 722 aa, Myxococcus xanthus DK 1622
MSRLLLVSNRLPVTVKVEKDTVSVVRSAGGLATGLRRPHERSGGLWIGWPGDVSRLSESQRARVDAQLAELRCVPLTLSASEVSRYYEGYSNRVLWPLCHYMLERIPRQDRDWEVYRKVNERFADLVAKHYEPGDTIWVHDYQLMLVPGMLRQRLPGARIGYFHHIPFPSSEIFSTLPRRRELLKGLLGADLIGFHTVSYVRHFSGALLRHLGLDTDIDRIIWEGRDVRVGAFPMGIDAQAFESIASEPGMQEEVANLRRSSEGQRILLGIDRLDYTKGIPRRLLAVQRVLERTPAWRGRLRFIQVTVPSRTQVEAYANYRELVNELVGRINGLYGTVHNVPVHYLYRSFNERQLVGLYRGADVMLVTPVRDGMNLVAKEFCAARPDDDGVLVLSEFAGAAAELGGALIVNPYDVDAMADAIEKALGMAEEERRTRMHTLRKQVKSRDVHWWTSSFLDRLQSLPAVDVRAEASAPEALAQMKQVERLQLLLDYDGTLVGYAPRPELAAPDAALKELLAKLVARPGISVSIVSGRPKETLEEWLGDLAMGLYAEHGLWSRPAPGEAWRMLEGVTFDWKERVRPELETFSARVPGSFVEEKTASLAWHYRLVDAEFGAIQSRELRLYLAEKFAGQSMDILPGDKVVEIRPRGVHKGRVVGEATKDAAPGALVVAIGDDRTDEDLFASIPPGGLTIHAGNKPTRAAFRVNGPDEVRALLAGLLEP

SEQ ID NO: 450 - protein, 828 aa, Vitis vinifera
MMSRSYTNLLDLASGNFPLMGQRKRLPRVMTVPGVISELDDDQANSVTSDVPSSIVQDRVIIVANQLPVKAKRRPDNKGWSFSWDEDSLLLQLKDGLPDDMEVLYVGSLRVDVDSNEQDDVSQVLLDRFKCVPAFLPQDILSKFYHGFCKQQLWPLFHYMLPFSANHGGRFDRSLWEAYVSANKIFSQRVIEVLNPEDDYVWIHDYHLMVLPTFLRRRFNRLRMGFFLHSPFPSSEIYRTLPVREEILKALLNSDLIGFHTFDYARHFLSCCSRMLGLEYQSKRGYIGLEYYGRTVGIKIMPVGVHMGQIESVLRFADKEWRVGELKQQFEGKTVLLGVDDMDIFKGVNLKLLAMEQMLTQHPKWQGRAVLVQIANPARGSGRDLEVIQAEIQASCKRINENFGQPGYEPIVFIDRPVSLSEKAAFYTIAECVVVTAVRDGMNLIPYEYIVSRQGKSMLVVSEFIGCSPSLSGAIRVNPWNVEATAEAMNEAISMADAEKQLRHEKHYRYVSTHDVAYWSKSFFQDMERSCKDHFRRWFVALDPNFRKLSIDSIVSAYSRAKNRAILLDYDGTVMPQTSINKTPSEDVILILNTLCSDPRNTVFVVSGRGRDSLGKWFSPCNRLGIAAEHGYFLRWSVNEEWEICGQSNDFGWIQMAEPVMKLYTEATDGSYIETKESALVWHHQDADPGFGSSQAKEMLDHLESVLANEPVAVKSGQFIVEVKPQGISKGVVAEKIFTSMAERGRQADFVLCVGDDRSDEHMFEIIGNAVSSGILSSNTSVFACTVGQKPSKAKYYLDDTTEVINMLDALADASDPSPSPELEASSP

SEQ ID NO: 451 - protein, 662 aa, Arabidopsis thaliana
MAASNHSSGKPGGVLSDALCRELWHACAGPLVTLPREGERVYYFPEGHMEQLEASMHQGLEQQMPSFNLPSKILCKVINIQRRAEPETDEVYAQITLLPELDQSEPTSPDAPVQEPEKCTVHSFCKTLTASDTSTQGGFSVLRRHADDCLPPLDMSQQPPWQELVATDLHNSEWHFRHIFRGQPRRHLLTTGWSVFVSSKKLVAGDAFIFLRGENEELRVGVRRHMRQQTNIPSSVISSHSMHIGVLATAAHAITTGTIFSVFYKPRTSRSEFIVSVNRYLEAKTQKLSVGMRFKMRFEGEEAPEKRFSGTIVGVQENKSSVWHDSEWRSLKVQWDEPSSVFRPERVSPWELEPLVANSTPSSQPQPPQRNKRPRPPGLPSPATGPSGPDGVWKSPADTPSSVPLFSPPAKAATFGHGGNKSFGVSIGSAFWPTNADSAAESFASAFNNESTEKKQTNGNVCRLFGFELVENVNVDECFSAASVSGAVAVDQPVPSNEFDSGQQSEPLNINQSDIPSGSGDPEKSSLRSPQESQSRQIRSCTKVHMQGSAVGRAIDLTRSECYEDLFKKLEEMFDIKGELLESTKKWQVVYTDDEDDMMMVGDDPWNEFCGMVRKIFIYTPEEVKKLSPKNKLAVNARMQLKADAEENGNTEGRSSSMAGSR

SEQ ID NO: 452 - protein, 434 aa, Leptospira interrogans serovar Lai str. 56601
MRRNIVHSGADALIYEIRQIVAVAKKLEALGLQITYENIGDPILKGESIPDWMKEIVSNLILKDKSWAYTATQGYEPTRKFLAEKVNERRGAQITADDLLFFNGLGDAVAKIFGFMRREARVLGPSPAYSTISSAEAAHSGYEHLTYNLLPEHNWMPDLEDMENKVKYNDSIAGILLINPDNPTGAVYDKNLMKKIVAICEKYDLMLICDETYAHVNYSDHGPLHLSEVIGDKVPGMALRSISKEFPWPGGRCGWLEIFNKEKDPVFSRYVKSLLDAKMLEVCSTTLPQMAIPEVYSHPDFIPHLKRRNEKFKKRAHVATEYFAELRGVKVVEPKGAFYLTVAFDDDVLNSSMKLEIENKKADEFIQPLLASAANDRRFVYYLLASTGICVVPLSAFCTLKDGFRVTLLEEDEEKFNWIYKTLRDKIGEYIASA

SEQ ID NO: 453 - protein, 432 aa, Methanocaldococcus jannaschii DSM 2661
MRNPIIDVGAKELSYEIREIVDVAKKIEEFGINITWENIGDPVAKGEKIPDWIKDIIAEIVKNDCSYAYCPTKGLLETREFLAEQVNKRGGVQITAEDIIFFNGLGDAIAKIYGLLKRQVRVINPSPSYSTHSSAEASHAGSPPVTYFLDPYNYWYPDIDDLEKRIKYNPAVSGILVINPDNPTGAVYPKKILNEIVDLANEYDLFIICDEIYCNLVYNGKKQHLLCEVIDDVCGLSLKGISKELPWPGARCGWIEIYNADKDEEFKKYVESIYKAKLIEVCSTTLPQMAIPRIMGHRNYKKYLEERNRFFEKRSNTAYKKLKDLDGVIANKANGAFYMSVVFEDNYLNGNNSIKIENEKLKEFIEHQIKDASIDKKFVYYLLASTGICVVPLTSFCSQLNGFRVTLLERDDEKFEWIFDTLAEKIDEFLKT

SEQ ID NO: 454 - protein, 636 aa, Arabidopsis thaliana
MANRGGEYLYDELWKLCAGPLVDVPQAQERVYYFPQGHMEQLEASTQQVDLNTMKPLFVLPPKILCNVMNVSLQAEKDTDEVYAQITLIPVGTEVDEPMSPDPSPPELQRPKVHSFSKVLTASDTSTHGGFSVLRKHATECLPPLDMTQQTPTQELVAEDVHGYQWKFKHIFRGQPRRHLLTTGWSTFVTSKRLVAGDTFVFLRGENGELRVGVRRANLQQSSMPSSVISSHSMHLGVLATARHATQTKTMFIVYYKPRTSQFIISLNKYLEAMSNKFSVGMRFKMRFEGEDSPERRYSGTVIGVKDCSPHWKDSKWRCLEVHWDEPASISRPNKVSPWEIEPFVNSENVPKSVMLKNKRPRQVSEVSALGITASNLWSSVLTQPHEFAQSCITSQWSSPQQCHRDANEDAKKSDWLNNSYSVSNVAKDSTLNDQMVSPVEQKKPETTANYRLFGIDLMSSSLAVPEEKTAPMRPINISKPTMDSHSDPKSEISKVSEEKKQEPAEGSPKEVQSKQSSSTRSRTKVQMQGVPVGRAVDLNALKGYNELIDDIEKLFDIKGELRSRNQWEIVFTDDEGDMMLVGDDPWPEFCNMVKRIFIWSKEEVKKMTPGNQLRMLLREVETTLTTTSKTDNHSN

SEQ ID NO: 455 - protein, 470 aa, Arabidopsis thaliana
  misc_feature (440)..(440): Xaa can be any naturally occurring amino acid
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGXDEMPEIMDSFKKFNDEFMTQYDNNFGYSKM

SEQ ID NO: 456 - protein, 622 aa, Gibberella zeae PH-1
MRPKLLSVEAALFLALPELARAATRKFDFEIGWVRANPDNAFERPVIGINGQWPIPTIEVDIGDRVIINAHNNLGNQSTSLHFHGLYMNGSTHMDGPAGVSQCPIIPGTSFTYNFTVDQPGTYWYHSHTAAQYPDGLRGPFIVHDKDFPYAKKYDEEVVLTLSDWYHDEMRSLIPQFMAKSNPSGAEPVPKNALMNETTNFTMSVQPEKTYLFRVINVGAFAGQYLWFEGHKMQIVEVDGIYTEEAEAEMIYISAAQRVSFLLTTKKDTSKNFPIVASMDTTLFDVLPPDLKYNSTGWLVYDKKAEKPVPATVDSLNPFDDMTLVPYDKMEILGKPDKEVVLDVKMDNLKDGKNYAFFNDITYTEAKVPTLYTALSAGKDAEDPAVYGTYTHSMVLKKNEIVQLVVNNLDSGRHPFHLHGHAFQSVYRSEEEAGIWADANVTEKNLPKTPMRRDTLVIYPNGNIVMRFKADNPGVWLFHCHIEWHVISGLIATFVEDPLALQETIEIPKNHLDACAAANMPTKGNAAANTEDFLDLTGENKPANTLPPGFTPRGIVALVFSCICGILGVAVVAWYGFSAPVGSTSAGALSAGLVENDSGDVHSAQKGPQETVVSPTGDARSH

SEQ ID NO: 457 - protein, 520 aa, Agaricus bisporus
MRLSNALVLVAACISSVVAKTRTFDFDLVNTRLAPDGFERDTVVINGEFPGTLIQVNKGDSVRIPLHNKLTSPTMRRSVSIHWHGFFQARTSGQDGPSFVNQCPQPPNTTFTYEFSVAEQSGTFWYHSHLSTQYCDGLRGAFIVYDPRDPLRHLYDVDDESTVITLAEWYHILAPDATNEFFSSGIIPVQDSGLINGKGRFNGGPLTPFAVVNVRRGKRYRLRVIAISCRPFFTFSVDNHSLVFMEADGVEHDPVEVQNVDIYAAQRVSVILHANQPIDNYWIRAPMTGGNPDRNPNLNISLTLAILRYHGARHVEPTTVNVPGHKLLDQEMHPIRQEGPGKLGDGPPDKHITLNIAQPNAPFFDINGISYISPTVPVLLQILSGAKRPEDVLPSEQIFFVPKNSLIEVNIPGEGAHPFHLHGHNFDVVLASNDDTFNFKNPPRRDVYPINGGNTTFRFFTDNPGAWFLHCHIDWHLEAGLAIVFAEAPEDNVSGPQSQITPQDWLDLCPEYNAIEPEFQ

SEQ ID NO: 458 - protein, 1312 aa, Ustilago hordei
MPRRGNLGGHRVVIASLFLPDTLHFVEPEFESALAESPQESTAPPSPDSLPHDAPLPLHELSSRLAASMSMSAQDRQTRSMPVAAKTPMNRQSSLTDTKINMSELMYEAAAVPKLDMREGPISGASSPLTRSRRGSMSEHPAADIPVAPASDHGRAAMTPDLNPLSVFSTSPLPGQTASITAAPKSRRSSFNTNTSSGTALAPAANVPEGTGTRTPGARAGGKLGITTPLSIISDLAARRGGPIPSLATTADSERHHPFGSGAVTPIAGAQTPGNANRPPGLARAFPSSLSMTKANPSGSVSAGPGALPTLKSLAAAKQVNTASGSRTPSGSSGLHGAKTASAVSSGSINDHGRGAAPTSAPNQARKASIPTAEKPSSRELLGHARTPREHSISSSLTASIKGRAHHHGGGAHSSGNQGPPAAPSSVFSRNHSIRSAPRRGSGRRASSASRSQLGRHTSTASLDTVMDDDADAALPPFDFVSNPSANGGLINAVRSIERERLRAGKVYVGTPGLSTEGWLGPSEKRILEQKYLKERSSMPVWLADDDFDLSYNRFCKQILWPTFHYTSPTSKGLDNEHEAFRAYWEVNRRFADAIEDIYQEGDIVWINDYHLLLVPQMVRERLPHATIGLFVHIAFPSSEIFRCLSMRETLLKGMLGADLIGFQTHNFCRHFRQTVSRILQLEATPKGVQLEGSFVTVAPFPIGIDVRSLNAKRQDPEVSEWVAQLRQKYAGKRIIVGRDKLDWIKGVRQKLLAFEAFLDENPMWAGEVVLIQVALATTEENEEIGEATDVVSRINNKYSSLTYQPVVFLHVQDITFSQYLALLTVADCFLATSLREGMNLTSHEFVVCQEVSHRPLVLSEFTGTYSGLRACIGINPWNTKQVAHAIHKALIMDESEMVQRWTDLHRVVVTQTAQQWITSLLGHLERAHMEQERLENMFVPKLEVAQLVSEWRAAHARLLLIDLEETLVTYDPLLAHEQGGFRPPEWLFTLLNDLAADNKNVVYILSGMGTNDLDRLASRIDSVGFAAEDGCFVKHAGEHHWNSLVAPFDLRPVRDILSYFTERTPGSYIEERSASMCWRFWNDKLGDRDSHEAQWARRQSAEVANLIHERFSHSLRVVPCRTNCLILPRHASRVAAVQHIIMQMSIIGSVAMSGGNASSQPSSASTPSLSAQKPNDITQRLADQPHHPPLESAYKQPSNYWTMPSAHNTRASSPVVHQSPMRSHAGLVSHHLPHHFHQTHTFDFVLALGQDEKLLAYVNTLDLFAPVTCTTVDLEKNRGTEAAYFLAQSEVQEALEEMVGFRARDLKWANR

SEQ ID NO: 459 - protein, 520 aa, Agaricus bisporus
MRFSNAFVLVAACISSVLADTKTFNFDLVNTRLAPDGFERDTVVINGEFPGTLVQVNKGDSVRIPVNNKLTSSTMRRSVSIHWHGFFQARTSGQDGPAFVNQCPQPPNTTFTYEFSVADESGTFWYHSHLSTQYCDGLRGAFVVYDPEDPLGHLYDVDDETTVITLAEWYHVLAPDINNEFFSSGIIPVQDSGLINGKGRFNGGPETPFAVVNVEQGKRYRFRVIAISCRPFFTFSVDNHNLTFMEADSVEHDPVEIQNVDIYAAQRVSVILNANQPVDNYWMRAPMTGGNPDRNPNLNISLTLAILRYKGAPEVEPTTVNVPGHKLLDQEMHPIAQEGPGKLGDGPPDKHITLNIAQPNAPFFDINGISYISPTVPVLLQILSGAKRPEDVLPSEQIFFVPKNSLIEVNIPGEGAHPFHLHGHNFDVVLASNDDTFNFVNPPRRDVYPINGGNTTFRFFTDNPGAWFLHCHIDWHLEAGLAIVFAEAPEDNVSGPQSQITPQDWLDLCPEYNAIEPEFQ

SEQ ID NO: 460 - protein, 490 aa, Streptomyces albus
MARQSPAVLVATKPAPVVHERVDERVVPRLSVSTGSVVGDMASRLRTTVVASAASEEDRALAERSPDGVTVRAAGGQEIRVRLVRHAPETLSTERYGLTTEVLWHTMHNLWDRWSAPSFDRASRRAWESLHALNQDITEALLAQSPGAGSGYLIHDYQLGMVPARLRRADPTARVLFFHHIAWPGPEGLALLPRQFADDLLRGMLGADVVCFFARRWCRNFLRCVEDLVPGARVDHDAGTVRLGGREVRVAAEPLSYSPDALKGLPRSWPKELDAWVGERPLVVHSGRTDPIKNAHRAVAAFRIAAEHPAAADARLLLRINPHRLHIGANAAYLRMTEEAVAEANRHFGEERVRLLTGNDRGLTFGALARADAVVLNSTADGQNLTAFEAIAMGAREPVLVVSHTCGAGEVLGDGALRVHPHDLVDQADALVEALTMTPSRRTAASRVLHEAAARFALPHWTERQLGLLGIDMPESARAAVPAAGRAHDA

SEQ ID NO: 461 - protein, 494 aa, Bradyrhizobium japonicum USDA 110
MNRRGRPVNLVVVSNRVARGKPNEPMTGGLAAALLPVVEHSGAIWVGSSGRVRDGHQKEPFAEIEALGSGAIATLDLPAAHYGGYYEGFANSALWPALHSRSDLIRVSREDYVSYREVNAFMARALMRFRKPRTAFWVQDYHFLALGAELRDLGVDDPIGFFLHTPWPVAAVTQGVPNHRELITAMLAYDLIGFQTEEDRQNFLGYVAGELGLVIDDGVVLSQHGRTRCEVFPIGIDAEKFAQYAAKSASHPDVSRLRRSLNGERLAIGVDRLDYSKGLVNRISAFDRLWTEQPQFLRSISLLQIANPSRGAIEAYGNLQNEVARLVTDVNGRHGEVDWTPIRYLNKGFSQAVLAGLYRTAQIGVVTPLHDGMNLVAKEYVAAQNPADPGVLVLSKFAGAANELDTALLVNPHDIDAMARAIAIAAAMPLTERKMRWDAMMKKLRGHTIQQWSADFVAELEKCRIEKAAVAPLAAQPPQALRWLKSAISGVRLI

SEQ ID NO: 462 - protein, 171 aa, Neptuniibacter caesariensis
MKAALFYGTTTGNTGDIAEKIKDEWDAGEIDLFDVADSSIGAVMDYELLIFAIPTWDYGEVQEDWLDIWDEVDSIDFTGKQTAFIGLGDQFGYPEWFVDAMGMLHDKIVAKGGEVVGHWSIEGYEFDESKALTKDKKHFIGLALDEDWQREQTPERLTNWLDQVKLELGLF

SEQ ID NO: 463 - protein, 533 aa, Pleurotus eryngii
MAVAFIALVSLALALVRVEASIGPRGTLNIANEVIKPDGFSRSAVLAGGSYPGPLIKGETGDRFQINVVNKLADTSMPVDTSIHWHGIFVRGHNWADGPAMVTQCPIVPGHSFLYDFEIPDQAGTFWYHSHLGTQYCDGLRGPFVVYSKNDPHKRLYDVDDESTVLTVGDWYHAPSLSLSGVPHPDSTLFNGLGRSLNGPASPLYVMNVVKGKRYRIRLINTSCDSNYQFSIDGHAFTVIEADGENTQPLQVDQVQIFAGQRYSLVLNANQAVGNYWIRANPNSGDPGFANQMNSAILRYKGARNVDPTTPERNATNPLREYNLRPLIKEPAPGKPFPGGADHNINLNFAFDPATVLFTANNYTFVPPTVPVLLQILSGTRDAHDLAPAGSIYDIKLGDVVEVTMPALVFAGPHPMHLHGHSFAVVRSAGSSTYNYENPVRRDVVSIGDDPTDNVTIRFVADNAGPWFLHCHIDWHLDLGFAVVFAEGVNQTAVANPVPEAWNDLCPIYNSSNPSKLLMGTNAIGRLPAPLKA

SEQ ID NO: 464 - protein, 412 aa, Burkholderia thailandensis E264
MKPIQKSNKLLNVCYDIRGPVLEHAKRLEEEGHRIIKLNIGNLAPFGFDAPDEIIQDMIRNLPTSSGYSDSKGVFAARKAIMHYTQQKGVHGVGLDDIYIGNGASELIVMATQALLNDGDEVLLPAPDYPLWTAAVSLSGGTPVHYICDESNRWMPDPDDIRRKITPNTKALVVINPNNPTGALYSDELLVELIAIAREHGLIIFADEVYDKIVYDGQSHTALASLAPDVITVTFNSLSKSYRSCGYRAGWMSVAGLTAENRRRAHDYLEGLGILSSMRLCANVPGQYAIQTALGGYQSINELIMPSGRLYKQRELAYDMLTAIPGVSCVKPEAALYMFPRLDPKLYPIENDQQFILELLLKERVLLVQGTGFNWPTPDHFRVVFLPNVDDLTDSIERIARFLDGYRKRHSA

SEQ ID NO: 465 - protein, 259 aa, Zea mays
VPYFLDEETGWALEVDELKKQLEEARSKGISVRALVVINPGNPTGQVLTEENQKKIVEFCKNERLVLLADESISKGYYGECGKRGGYMEITGFSPQVRDQIYKMASINLCSNITGQILASLVMNPPKAGDESFESFRLERDGILSSLGRRAKALEEAFNSLEGITCNKAEGAMYLFPRLHLPRKAIGAAQAAGTAPDAYYAKRLLEATGIVFVPGSGFGQVPGTWHIRSTILPQEDKIPGIVSRFKEFHDKFMDEFRDY

SEQ ID NO: 466 - protein, 254 aa, Zea mays
MTTRQVLTEENQKKIVEFCKNERLVLLADEVYQENIYVEDKQFHSFIIIARSLGYTDDDLPLVSFQSISKGYYGECGKRGGYMEITGFSPQVRDQIYKMASINLCSNITGQILASLVMNPPKAGDESFESFRLERDGILSSLGRRAKALEEAFNSLEGITCNKAEGAMYLFPRLHLPRKAIGAAQAAGTAPDAYYAKRLLEATGIVFVPGSGFGQVPGTWHIRSTILPQEDKIPGIVSRFKEFHDKFMDEFRDY

SEQ ID NO: 467 - protein, 531 aa, Pleurotus eryngii
MFPGARILATLTLALHLLHGTHAAIGPIADMYIVNEDVSPDGFARSAVVARSVPATDPTPASVSVPGVLVQGNKGDNFQLNVRNQLSDSTMLKTTSIHWHGFFQSGSTWADGPAFVNQCPIASGNSFLYDFNVPDQAGTFWYHSHLSTQYCDGLRGPFVVYDPSDPHLSLYDVDNADTVITLEDWYHVAAPQGAVLPTPDSTLINGKGRFAGGPTSPLAIINVESNKRYRFRLISMSCDPNFTFSIDGHSLQVIEADAVNIVPLVVDSIQIFAGQRYSFVLNANQAVDNYWIRANPNLGSTGFEGGINSAILRYAGATENDPATTSSTSTPLLETNLVPLENPGAPGPAVPGGADININLAMGFDFTNFEMTINGSPFKAPTAPVLLQILSGATPAASLLPSGSIYALEANKVVEISIPALAVGGPHPFHLHGHTFDVIRSAGSTTYNFDTPARRDVVNTGIDANDNVTIRFVTDNPGPWFLHCHIDWHLEIGLAVVFAEDVASIKAPPAAWDDLCPIYDALSDSDRGGIA

SEQ ID NO: 468 - protein, 174 aa, Prochlorococcus marinus str. AS9601
MTVGIYYATTTGKTEDVADRLHNFISSAEAPKDVSDVDDLSEFEGLDGIICGIPTWNTGADEERSGTAWDSILEDIGELSLSGKKVAIFGLGDSSTYTENYCDAMEELHSYFTKAGAEMVGYVDKSSYTFDESKSVIGESFCGLPLDEDSESDLTDSRLETWASQLKGEIPSLA

SEQ ID NO: 469 - protein, 533 aa, Pleurotus eryngii
MAVAFIALVSLTLALVRVEASIGPRGTLNIANEVIKPDGFSRSAVLAGGSYPGPLIKGETGDRFQINVVNKLADTSMPVDTSIHWHGIFVRGHNWADGPAMVTQCPIVPGHSFLYDFEIPDQAGTFWYHSHLGTQYCDGLRGPFVVYSKNDPHKRLYDVDDESTVLTVGDWYHAPSLSLSGVPHPDSTLFNGLGRSLNGPASPLYVMNVVKGKRYRIRLINTSCDSNYQFSIDGHAFTVIEADGENTQPLQVDQVQIFAGQRYSLVLNANQAVGNYWIRANPNSGDPGFANQMNSAILRYKGARNVDPTTPERNATNPLREYNLRPLIKEPAPGKPFPGGADHNINLNFAFDPATVLFTANNYTFVPPTVPVLLQILSGTRDAHDLAPAGSIYDIKLGDVVEVTMPALVFAGPHPMHLHGHSFAVVRSAGSSTYNYENPVRRDVVSIGDDPTDNVTIRFVADNAGPWFLHCHIDWHLDLGFAVVFAEGVNQTAVANPVPEAWNDLCPIYNSSNPSKLLMGTNAIGRLHAPLKA

SEQ ID NO: 470 - protein, 527 aa, Trametes versicolor
MGKFHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDANASLYDVDDDTTVITLADWYHTAAKLGPAFPAGPDSVLINGLGRFSGDGGGATNLTVITVTQGKRYRFRLVSISCDPNFTFSIDGHNMTIIEVGGVNHEALDVDSIQIFAGQRYSFILNANQSIDNYWIRAIPNTGTTDTTGGVNSAILRYDTAEEIEPTTNATTSVIPLTETDLVPLDNPAAPGDPQVGGVDLAMSLDFSFNGSNFFINNETFVPPTVPVLLQILSGAQDAASLLPNGSVYTLPSNSTIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTAWSDLCPTYDALDSSDL

SEQ ID NO: 471 - protein, 519 aa, Trametes versicolor
MGLQRFSFFVTLALVARSLAAIGPVASLVVANAPVSPDGFLRDAIVVNGVVPSPLITGKKGDRFQLNVDDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTTSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 472 - protein, 518 aa, Pycnoporus coccineus
MSRFQSLLSFVLVSLAAVANAAIGPVADLTLTNAAVSPDGFSREAVVVNGQTPGPLIAGQKGDRFQLNVIDNLTNHTMLKTTSIHWHGFFQHGTNWADGPAFINQCPIASGHSFLYDFQVPDQAGTFWYHSHLSTQYCDGLRGPFVVYDPNDPQASLYDIDNDDTVITLVDWYHVAAKLGPRFPLGADATLINGLGRSPGTTAADLAVIKVTQGKRYRFRLVSLSCDPNHTFSIDGHTMTIIEADSVNTQPLEVDSIQIFAAQRYSFVLDASQPVDNYWIRANPSFGNTGFAGGINSAILRYDGAPEVEPTTTQTTSTKPLNEVDLHPLTPMAVPGRPEPGGVDTPLNMVFNFNGTNFFINDHSFVPPSVPVLLQILSGAQAAQDLAPSGSVYVLPSNSSIEISFPATANAPGAPHPFHLHGHTFAVVRSAGSSEYNYDNPIFRDVVSTGTPGDNVTIRFQTNNPGPWFLHCHIDFHLDAGFAVVMAEDTPDTAAANPVPQSWSDLCPIYDALDPSDL

SEQ ID NO: 473 - protein, 520 aa, Trametes versicolor
MGRFSSLCALTAVIHSFGRVSAAIGPVTDLTISNADVSPDGFTRAAVLANGVFPGPLITGNKGDNFQINVIDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPIGSDSTLINGLGRFAGGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVPLDSPAAPGDPNIGGVDYALNLDFNFDGTNFFINDVSFVSPTVPVLLQILSGTTSAADLLPSGSLFALPSNSTIEISFPITATNAPGAPHPFHLHGHTFSIVRTAGSTDTNFVNPVRRDVVNTGTAGDNVTIRFTTDNPGPWFLHCHIDFHLEAGFAIVFSEDTADVSNTTTPSTAWEDLCPTYNALDSSDL

SEQ ID NO: 474 - protein, 529 aa, Pleurotus ostreatus
MFPGARILATLTLALHLLHGTHAAIGPTGDMYIVNEDVSPDGFTRSAVVARSDPTTNGTSETLTGVLVQGNKGDNFQLNVLNQLSDTTMLKTTSIHWHGFFQSGSTWADGPAFVNQCPIASGNSFLYDFNVPDQAGTFWYHSHLSTQYCDGLRGPFIVYDPSDPHLSLYDVDNADTIITLEDWYHVVAPQNAVLPTADSTLINGKGRFAGGPTSALAVINVESNKRYRFRLISMSCDPNFTFSIDGHSLQVIEADAVNIVPIVVDSIQIFAGQRYSFVLNANQTVDNYWIRADPNLGSTGFDGGINSAILRYAGATEDDPTTTSSTSTPLEETNLVPLENPGAPGPAVPGGADININLAMAFDVTNFELTINGSPFKAPTAPVLLQILSGATTAASLLPSGSIYSLEANKVVEISIPALAVGGPHPFHLHGHTFDVIRSAGSTTYNFDTPARRDVVNTGTDANDNVTIRFVTDNPGPWFLHCHIDWHLEIGLAVVFAEDVTSITAPPAAWDDLCPIYDALSDSDKGGIA

SEQ ID NO: 475 - protein, 167 aa, Fusobacterium nucleatum subsp. nucleatum ATCC 25586
MKTVGIFFGTTGGKTQEVVDIIAAQLGDAQVFDVANGVAEMEVFDNIIMASPTYGMGELQDDWASVIDEVADMDFSGKVVAFVGVGDAAIFGGNYVEAMKHFYDAVQPKGAKIVGFTSTDGYDFEASEAVIDGDKFMGLAIDASFDTDEITSKVEDWLENKVKDELL

SEQ ID NO: 476 - protein, 479 aa, Zea mays
MARRRPMDYEELNEKVKKAQYAVRGELYLRASQLQKEGKKIIFTNVGNPHALGQKPLTFPRQVVALCQAPFLLDDPNVGLMFPPDAIVRAKRYLAMAPGGLGAYSDARGIPGIRKEVADFIHKRDGYPSDPELIYLTDGASKGVMQMLNAIIRNERDGILVPVPQYPLYSAIISLFGGSLVPYYLEEEANWNLDFANIRQAVAEARSKGITVRATVIINPGNPTGQCLSEANIRELVRYCYHENLVLLADEVYQQNVYQDERPFISARKVMFDMGPPISREVQLVSFHTVSKGYWGECGQRGGYFEMTNLPPKTVDEIYKVASIVLSPNVPGQIFMGVMVNPPKPGDISYPKFTAESKSILESLRRRARMMTDGFNSCRNVVCNFTEGAMYSFPQIQLPARAIEAAKRAGKAADVFYCLKLLEATGISTVPGSGFGQKEGVFHLRTTILPAEEDFPTIMSSFKKFNDSFMEQYEGYSRM

SEQ ID NO: 477 - protein, 518 aa, Pycnoporus coccineus
MSRFQSLLSFVLVSLAAVANAAIGPMADLTLTNAAVSPDGFSREAVVVNGQTPGPLIAGQKGDRFQLNVIDNLTNHTMLKTTSIHWHGFFQHGTNWADGPAFINQCPIASGHSFLYDFQVPDQAGTFWYHSHLSTQYCDGLRGPFVVYDPNDPQASLYDIDNDDTVITLVDWYHVAAKLGPRFPLGADATLINGLGRSPGTTAADLAVIKVTQGKRYRFRLVSLSCDPNHTFSIDGHTMTIIEADSVNTQPLEVDSIQIFAAQRYSFVLDASQPVDNYWIRANPSFGNTGFAGGINSAILRYDGAPEVEPTTTQTTSTKPLNEVDLHPLTPMAVPGRPEPGGVDTPLNMVFNFNGTNFFINDHSFVPPSVPVLLQILSGAQAAQDLAPSGSVYVLPSNSSIEISFPATANAPGAPHPFHLHGHTFAVVRSAGSSEYNYDNPIFRDVVSTGTPGDNVTIRFQTNNPGPWFLHCHIDFHLDAGFAVVMAEDTPDTAAANPVPQSWSDLCPIYDALDPSDL

SEQ ID NO: 478 - protein, 405 aa, Moritella sp. PE36
MYSIEKSHKLDNVCYDIRGPVLKEANRLEEEGHRVIKLNIGNPAPFGFEAPEEIVKDVIHNLPSSQGYCDSKGLYSARKAVMQHYQQKGLLNISIDNIYLGNGVSELIMMSMQALLNNGDEVLVPSPDYPLWTAAITLSGGKATHYICDEESDWYPDLDDIKAKITPNTKGIVLINPNNPTGAVYNKEFLLEVVEVARQHNLIIFSDEIYDKILYDGVEHVPMCTLAQDILIVTFNGLSKAYRIAGFRSGWLVLSGATHLAKDYIAGLEMLASMRLCSNVPMQHAIQTALGGYQSINELILPGGRLLEQRDLAWKMLNDIPGITCVKPKGALYLFPKIDMEMFNIKDDQKFALDLLQQEKLLIVQGTGFNWSRPDHFRVVFLPRVEELTIAINKLANFLSTYRQA

SEQ ID NO: 479 - protein, 404 aa, Haemophilus somnus 129PT
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKHQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLARFLEYYRQ

SEQ ID NO: 480 - protein, 533 aa, Pleurotus ostreatus
MFPGARILATLTLALHLLHGAHAAIGPAGNMYIVNEDVSPDGFARSAVVARSVPATDPTPATASIPGVLVQGNKGDNFQLNVVNQLSDTTMLKTTSIHWHGFFQAGSSWADGPAFVTQCPVASGDSFLYNFNVPDQAGTFWYHSHLSTQYCDGLRGPFVVYDPSDPHLSLYDIDNADTVITLEDWYHIVAPQNAAIPTPDSTLINGKGRYAGGPTSPLAIINVESNKRYRFRLVSMSCDPNFTFSIDGHSLLVIEADAVNIVPITVDSIQIFAGQRYSFVLTANQAVDNYWIRANPNLGSTGFVGGINSAILRYAGATEDDPTTTSSTSTPLLETNLVPLENPGAPGPPVPGGADININLAMAFDFTTFELTINGVPFLPPTAPVLLQILSGASTAASLLPSGSIYELEANKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDDLCPIYNALSDNDKGGIVPS

SEQ ID NO: 481 - protein, 942 aa, Arabidopsis thaliana; identical to SEQ ID NO: 428

SEQ ID NO: 482 - protein, 173 aa, Picea sitchensis
MKLYTETTDGSTIEAKESALVWHHQDADPDFGSCQAKELLDHLESVLANEPVVVKSGHHIVEVKPQGISKGLVAEQLLSTMVQRGKRPDFVLCIGDDRSDEDMFEGITRAVSGPTLSPIAEVFACTVGQKPSKAKYYLDDTVDVVRMLQGLATASDQAVKNLSAQVAELTLTT

SEQ ID NO: 483 - protein, 840 aa, Xanthomonas oryzae pv. oryzae KACC10331
MASAPSGTIDTGRPLARPFAAIVLRNAGGELFGSAGHFHPQLHVIGHPLRIQQVGLDCRAHRTAWLGDMRAIVEAALRRQRLHIRKTAFGQILFAGRLELAHAGRVDQTRTGRQRNQRAVRGGVTAARIVFAHPIGLHLLGAQQGVGQGRFARTGRAHQYRRTAIAQPRPQRSHAGRILGIDRAQRNVLRLQLFQHRQRILGMFGLIGLGQHHHRLRTAAAHQQQIALDATRIEVRIQPAHDEHRIDIGRDHLLVVMRAGRPPLDRSAPRQQRHDALALHQHPIAHRRPLMAGEARPLPLRQRLGLEAGLRRIGHHIAGAVLLHHPRRQRLRMRGEDCLPGRLFRRPRPGPADGLEGGVIGGDVAHGAILAGWPQRLVQSGPAGRLTRHLTSLPMQACPLVIFPIPCQVSRLQPARRMSTAPQKPLAIRERLSEVRYEIRGELARRARELEAQGRKLIKLNIGNPGAFGFRAPEHLQRAIADDMGRTDPYTHQQGLLEAREAVAKAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRALLERIVAIATKHNLLLLVDEIYDQVLYDGAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNKEGVLVVPGSSFNVPYRHHFRVTLMPEASVMRDVFARIDRALARRAEAVTKVVPLKSRSVA

SEQ ID NO: 484 - protein, 416 aa, Burkholderia xenovorans LB400
MPAVKPILKSNKLLNVCYDIRGPVLEHAKRLEEEGHRIIKLNIGNLAPFGFDAPDEIIQDMILNLPGSSGYSDSKGVFAARKAIMHYTQQKGVHGVELDDIYIGNGASELIVMALQGLLNDGDEVLLPAPDYPLWTAGVSLSGGTPVHYICDESNSWMPDLDDIRAKITPNTRALVVINPNNPTGALYSDELLLGLIEIARQHGLVIFADEVYDKIVYDGKKHTSMAALSEDVLTVTFNSLSKSYRSCGYRAGWMFISGLTAGENRRHAKDYFEGLGILASMRLCPNVPGQYAIQTALGGYQSINDLIVPSGRLYKQRELAYDMLTAIPGVSCVKPEAALYMFPRLDPKIYPIQDDQQFILDLLLEERVLLVQGTGFNWPTPDHFRVVFLPNVDDLADSINRIARFLDGYRKRHTA

SEQ ID NO: 485 - protein, 171 aa, Prochlorococcus marinus str. NATL2A
MTVGIYFATTTGKTEDIAERLHGLLDSAEGPKDISDVDDLSELAGHDGVICGIPTWNTGADSERSGTAWDSILEDIGELDLSGKKVAIFGLGDSSTYTENYCDAMEELHRYFQQAGASMVGYTAKTDYTFDESKSVVGEEFCGLPLDEDSESDMTDERLSGWAEKLKGEMF

SEQ ID NO: 486 - protein, 442 aa, Azoarcus sp. BH72
MNAAKTLNLAPAPTEPLVAVEAGAAAASPSPLSTPRAVRKSAKLADVCYDIRGPVLTRAKQMEDEGHKIIKLNIGNLASFGFDAPEEIQMDMIRNLPNSAGYSDSKGIFAARKAVMHYTQQKHIKGVGMEDIYIGNGVSELIVMAMNALLNPGDEVLVPAPDYPLWTAAVSLSGGTPVHYICDEGNGWLPDLADMRERITPNTRAIVVINPNNPTGALYPEAVLKGIIALAREFDLILYADEVYDKVLYEGAVHTSLAALSEDVLTIIFNGLSKNYRSCGYRAGWMVVCGDKRNAQDYIEGLNMLASMRLCANVPGQYAIQTALGGYQSIDDLVADGGRLRRQRDLAHELITAIPGVSCVKPKAALYMFPRLDPKIYPIEDDQAFIAELLEAERVLLVQGTGFNWPDPDHFRLVFLPHEDDLRDAIGRVARFLEGYRKRHGT

SEQ ID NO: 487 - protein, 479 aa, Thermobifida fusca YX
MDKAQILVASNRGPVSFSIGDDGAVKSRRGGGGLVSGLSSVATEIETLWVCAALSDADRKAAAAAPEGRLDKAGYDVGGASVRMLNIPADVFNNAYNSVANSTLWFVHHMLYDTPNKPSFGSRFRAEWEDYRAYNSAFAEALLTGADEGAKVAVQDYHLALVPKMLRVRRPDLRIAHFSHTPWAPPEYFRMLPADIGRELLEGMLGADHLGFLSVRWADAFLRCCEVFLRAPVNWGTRTVEHGGRVIRVGVHGLGADAQGLRERAAAEDVARWRERLRERVGDRKLIVRVDRTELSKNIVRGLEAFGELLRKRPEWRNRVTHLAFAYPSRSGVAEYRAYTESVRATAEAINAEFGTDDWTPVVLEVNDDYPRSLASYQIADVLLVNPIRDGMNLVAKEGPVLSLNGVALVLSTEAGAADDLGADAILVNPYDVSETAEALHRALTMDEEERRQRTERLAEAAAALPPQRWFTDQLRALD

SEQ ID NO: 488 - protein, 496 aa, Flammulina velutipes
GIGPITDLVIANADVAPDGFTRTAALSGGTVNGALITGSRGDNFQINVVNNLNDNNILQSTSIHWHGMFMAGTSWADGPAFVNQCPIAKSNSFVYDFTALEQAGTFWYHSHLSSQYCDGIRGPMVIYDPDDPHAALYDVDNDDTVITLADWYHAFAKTLAFPTPDSTLINGLGRWAEDPTSDLAVINVESGVRYRFRLVSMSCDPNFVFAIQGHTLNIIEADGVSTEPVEVDQITIFAGQRYSFVLTADQAVDNYWIRAEPTPGPTGFEDGINSAILRYSGAAEAEPTDDTVESTNPLDEIALVPLENPGADGTAEVGADDVFAINLALAFDLSTFKFTVNGATFEPPTTPVLLQLLSGAQTADTLLPAGSLFTLPANRVVELSIPSEGLIGGPHPFHLHGHVFDVIRGPGQTDYNFENPPRRDVVSIGAAGDNVTIRFTTDNPGPWFLHCHIDWHLEAGLALVFAEDTDNWDVSTPPTSWDELCPIYDALSEDDL

SEQ ID NO: 489 - protein, 928 aa, Coccidioides immitis RS
MAHSSAESPPMLSNSTILPTRSQTSDGVCFGEQMNSSSRPADTKGHEPSNSAAAMSGVEHGTLGTSPGTPSEAAKGAKSGIELLRRLSLMEGRPTLSAMARPEEHADLRLTGRIISASFCIPYKLRFRSGLNWELHHRPGTSALFDSFQYLASSENPWSHTLVGWTGEVENSTLQDSYFQSRPHTGSGLESLSLETPMTSLSKASAPIPVDGSHKPQPPADGIHVKKEDRDRLEKQLHSSKYGMILPVWLSDDSESPEETLHLKDQTRWRRYAEREIYPLFHYKQHGPTDGRAERRWWQDYQRMNQLFADRILEIYRPGDIVWIHDYHLFLLPSMLRQRIPEIYIGFFLHVPFPSSEFFRCLTRRKEVLTGVLGSNMIGFQSFTYSRHFSSCCTRILRFDSNSAGIDAYGAHVAVDVFPIGIDVDAVRKMAYGEPNIEKTIAEIKKLYAGKKIIIGRDRLDSARGVTQKLIAFEMFLERYPEWRDKVVLIQVTSPTSVEEEKEESEAKLSSQMSHLVSTINGRYGSLSFSPVQHYPQYLSRHEYFALLRAADVGLITSVRDGMNTTSLEYVVCQHENHGPLILSEFSGTAGSLHNAIHINPWDSGGVAAAINEALTMSYEQREEQHEALYKYVTTHTVSIWSDLYIGRLLNNLSSFNQSIATPVLDKAKLLYQYRKARRRLFMFDYDGTLTPIVKDPQAAIPSDRVVRTLKSLAADPKNSVWIISGRDQNFLEEWMGHISELGLSAEHGCFIRKPHNEVWENLTEKSNMGWQKEVLDIFQHYTERTQGSFIERKRVALTWHYRRVDPEYGAYQAKECRKHLENTVARKWDVEIMAGKANLEVRPTFVNKGEIASRLVNECQGRPEFVLCLGDDFTDEDMFRALRHSNLPKDRVFAVTVGASSKQTEASWHLLEPADVIATISLLNSCN

SEQ ID NO: 490 - protein, 589 aa, Yarrowia lipolytica CLIB122
MTLTNKLLHLVLCLLLAATICGASPVDLAARDFSDHQNELPSPSASDKYFNWTVDWTIQNPDGVFPRRVISINGEWPLPVINVTKGDRVVIDLYNDLGTQNVSLHFHGLYQKGQNANDGPVWITQCPQTYHNQHTFMRYNFTVDQSGAYWYHSHVDGQYPDGLRQSFLIHDPEDPYKHDFDEHLSFTLSDWYHEEVPDLMVDFLSKYNPDGDEPIPSNLLFNDTQNVSIPVEPNRTYKLTIINVGAFVSQYIQFEDHQVQVIEVDGVATEKSEPTNLLYITTAQRYTVLLRTKDSATRNFAISTAMDSTMLDSLPDGLNLVQTNYLEYNKNAPKQPVKEWYVNGANYNDDAFKKKRFDDMALVPLDRQPLLPDADHTIVLNMTMDNLNDGINYAFFNNITYTHPKVPVLYTVLSSPNGLETNREIYGSNSNVFLLKHNEVVDVVINNQDDGEHPFHLHGRNFQVPYRSPEYDDDNMTAFDPALKKDFSPIPMRRDTVYVRPNGNFVLRYRANNPGVWFFHCHIEWHMSQGLALVMVEAPTEIKQKQTVPENHLQICQAGNVPTAGNAAANSRNWLDLSNQNLQAPGLPH

SEQ ID NO: 491 - protein, 178 aa, Glycine max
IRLEGGYMEVTGFSAEVREQIYKVASVNLCSNISGQILASLVMSPPKVGDESYDSFMAEKENILASLARRAKTLEDAFNKLEGVTCNKAEGAMYLFPQIRLSEKAIKAAEAANATPDNFYCKRLLNATGVVVVPGSGFGQVPGTWHFRCTILPPEEKIPAIVTRLTEFHEKFMDEFRD

SEQ ID NO: 492 - protein, 571 aa, Pisum sativum
MKILMLWLTWALALSFSSMVSAAIVERTFTIQNKTIKRLCHEQVIVTVNGLYPGPNMEVREGDSVIVHVINNSPYNITIHWHGVFQLLSAWADGPEYITQCSIRPENKYTYKFKVTQQEGTVWWHAHASALRATVHGAFIIQPRSGRFPFPKPYKEVPIILGDWYDGNVEDIVRKELETGDKISSDAFTINGFPGDLFNCSKNDVYNLRVKQGKTYLFRMVNAALNNNLFFKIANHNFTVVALDAAYTEPYNTDIIVLAAGQTADVLFTADQRKGPYFMAASPYVLGEPAPLFDNTTTRGIVVYDGYKKSKSSQLKPLMPALPLHNNTPIAHKFFSNITSLVKAPHWVPVPLEVDEHMYITINMALQPCPKNAKCTGPLGQKFSASMNNESFLLPVGKGFSIMEAYFYNVSGLYTTDFPNNPPKIFDFTNPKIFFDANVTFAPKSTKVKKFKFNSTVEIVFQNTAILNAQSHPMHLHGMNFHVLAQGFGSFDPKRDKLKYNLVNPLIHNTVAVPVGGWAAIRFRTNNPGVWFLHCHVDDHNLWGLVTAFIVENGPTPSTSLPPPPADLPKC

SEQ ID NO: 493 - protein, 160 aa, Zymomonas mobilis subsp. mobilis ZM4
MSINIIFGSDSGCTKKIALDMAKRIDGRAVNILKAEPSDFTDCSLLILGCPTYGDGELQIDWEDNLALLQEANLGNKTVAIFGTGDQDIYPDSFVDAIGILYDIVIERGAKVIGFTDTAGYQFTRSLAVRDDHFVGLALDEDNQPFETDDRIASWLKQIL

SEQ ID NO: 494 - protein, 192 aa, Rosa hybrid cultivar
DPFQDYHGLPEFRNAAANFMGKVRGNRVTFDPDRIVMSGGATGAHEMIAFCLADPGEAFLVPVPYYPGFDRDLRWRTGVQLLPVACESSNNFKITRAALEDAYEKAQKANIRVKGLLITNPSNPLGTVLDRETLKSLVTFINEKNIHLVCDEIYAATVFTQPRFISIAEILEEEEVGCNRDLVHVLSSFSCS

SEQ ID NO: 495 - protein, 480 aa, Physcomitrella patens subsp. patens
MASGKVMDPENLNENVKKTVYAVRGELYLRASELQKEGKKIIFTNVGNPHALGQKPLTFPRQVMALCQAPFLMDDPHVGLLFPADAIAKAKHYLSMTSGGVGAYSDSRGLPGVRQEVANFILQRDGYPSDPENIFLTDGASKGVAQVLNALIRDEKDGVLVPIPQYPLYSATIQLLGGTLVPYYLTEEENWGMSINELRRSVTEARRKGICVRGLVFINPGNPTGQCLTEKNLGELIEFCIQERIVLMADEVYQQNVYQDERPFISARKVLMGMGPPASEALELVSFHTVSKGFLGECGQRGGYFEMTNFHPKTVDELYKVSSIALSPNVSGQIMMGLMVNPPKPGDISYPQYEAESKAISLSLRKRAHIMTDGFNACENVVCNFTEGAMYSFPQVKLPQAAVAAAKKAGKAPDVFYCLRLLEATGISTVPGSGFGQKEGTFHVRTTILPSEKDMPGIMESFKKFNQDFMAQYADAKSKL

SEQ ID NO: 496 - protein, 182 aa, Rhodobacter capsulatus
MAKIGLFFGSDTGTTRKIAKQIKDMFDDEVMAKPLNVNRADVADFMAYDFLILGTPTLGDGQLPGLSANAASESWEEFLPRIADQDFSGKTIALFGLGDQVTYPLEFVNALFFLHEFFSDRGANVVGRWPAKGYGFEDSLAVVEGEFLGLALDQDNQAALTPERLKGWLSLIAADFGLVLPA

SEQ ID NO: 497 - protein, 404 aa, Photorhabdus luminescens subsp. laumondii TTO1
MLAVKKSSKLDNVCYDIRGPVLKEAKRLEEEGNKVLKLNIGNPAPFGFEAPDEILVDVIRNLPTAQGYSDSKGLYSARKAIMQHYQARNMMDVTVEDIYIGNGVSELIVQAMQALLNTGDEMLVPAPDYPLWTAAVSLSSGKAVHYMCDEGSDWFPDLNDIRNKITPRTRGIVIINPNNPTGAVYSKELLLEVVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHLRIVTLPRLDELEMAIQKFARFIGKYHQ

SEQ ID NO: 498 - protein, 176 aa, Escherichia coli O157:H7 EDL933
MAITGIFFGSDTGNTENIAKMIQKQLGKDVADVHDIAKSSKEDLEAYDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTAERVEKWVKQISEELHLDEILNA

SEQ ID NO: 499 - protein, 579 aa, Cucurbita maxima
MLQMGKAREPNFLILFFFGLILAFGISSEGSQIRHYKWEVEYMFWAPDCNENIVMGINGQFPGPTIRANAGDTVVVELINKLHTEGVVIHWHGILQRGTPWADGTASISQCAINPGETFFYNFTVDNPGTFFYHGHLGMQRSAGLYGSLIVDPPQGKKEPFHYDGEINLLLSDWWHQSIHKQEVGLSSKPIRWIGEPQTILLNGRGQFDCSIAAKYDSNLEPCKLKGSEPCAPYIFHVMPKKTYRIRIASTTALAALNFAIGNHPLLVVEADGNYVQPFYTSDIDIYSGESYSVLITTDQNPSENYWVSVGTRGRHPNTPPGLTLLNYLPNSVSKLPTSPPPETPAWDDFDRSKNFTYRITAAMGSPKPPVKSNRRIFLLNTQNVINGYVKWAINDVSLALPPTPYLGAMKFNLLHAFDQNPPPEVFPEDYDIDTPPTNEKTKIGNGVYQFKIGEIVDVILQNANMMKENLSEIHPWHLHGHDFWVLGYGDGKFTAEEESSLNLKNPPLRNTVVIFPYGWTAIRFVADNPGVWAFHCHIEPHLHMGMGVVFAEGVEKVGRIPTKALACGGTAKSLINNP

SEQ ID NO: 500 - protein, 174 aa, Crocosphaera watsonii WH 8501
MAKIGIFYGSTSGITEEIATTIREKLGEEECDLYSMEDDFDEYDQLLEYDYLLLGCSTWGAGDVQNDWRDPLFEMELEKPDFSGKTIALFGAGDQVDHGTEFVSALGKMYNHFKTLGATLVGEFPNEGYSFEYSSALVDDKFVGLPIDEINQSDKTEERIDQWVESIRPIFLDD

SEQ ID NO: 501 - protein, 453 aa, Ralstonia metallidurans CH34
MPPGLPRLASLIADAPPDAQDNPEIPRFRCRQRPAACPDIANTAVKPIQKSHKLQNVCYDIRGPVLEKAKQMEEEGHKIIKLNIGNLAVFGFDAPEEIQQDMMRNLPNSAGYSDSKGIFAARKAIMHYTQEKKIQGVGLDDIYVGNGASELIVMAMNALLNSGDEMLVPAPDYPLWTAAVSLSGGTPVHYVCDEANEWMPDLDDIRRKITPNTRGIVIINPNNPTGALYSDELLKEIVAIAREHGLIIFADEIYDKVLYDGNTHTSIGSLSTDVLTVTFNGLSKNYRSCGYRAGWMVVSGDKRPALDYIEGLNMLSSMRLCANVPGQWAIQTALGGYQSINDLVTEGGRLRRQRDLAYELITKIPGVTCVKPKAALYLFPKLDLSMYPIQDDQEFIYELLQESKVLLVQGTGFNWGAPDHFRIVFLPHEEDLREAITRVGRFLESYRKRHGTA

SEQ ID NO: 502 - protein, 171 aa, Thiomicrospira crunogena XCL-2
MSQVGLFYGTDTGNTERVADMIKDKIGSDIVDVHDIATASADDFAKYDKIILGQPTWYYGELQSSWDDFWDEFKEVDFTDKTFACFGLGDQADYAEYFLDAMGMMHDIALENGGIPTGYWSTDGYEFDESKAVTEDGEFFVGLAIDEDQQPEMTAERVDQWVDQIKDEMSL

SEQ ID NO: 503 - protein, 483 aa, Mycobacterium sp. JLS
MAPEGDQRVGSGDSDFVVVANRLPIDMERLPDGSTSIKRSPGGLVTALEPLLRKRRGAWIGWAGIPDSPEDPIEEDGLQLYPVALSADDVADYYEGFSNATLWPLYHDLIVKPIYHRKWWDRYVEVNRRFAEATARAAAQGATVWVQDYQLQLVPKMLRMLRPDLTIGFFLHIPFPPVELFMQMPWRTEIIEGLLGADLVGFHLPGGAQNFLYLSRRLTGANTSRASVGVRSRFGEVQVGFRTVKVGAFPISIDSAELDSKARNRSVRQRAREIRNELGNPRKILLGVDRLDYTKGINVRLEAFSELLEDGRVDRNDTVLIQLATPSRERVESYIAMREDIERQVGHINGEFGDVGHPIVHYLHRPVPRDELIAFFVAADVMLVTPLRDGMNLVAKEYVACRSDLGGALVLSEFTGAAAELRQAYLANPHHLEGVKDAIEAALNQDPEEGRRRMRALRRQVLAHDVDRWARAFLDALADTKSA

SEQ ID NO: 504 - protein, 172 aa, Aliivibrio fischeri
MKIGLFYGSSTCYTEMASEKIRAFIGEDLVDVFNIKETPVTTMNDYDLLLLGISTWDFGEIQEDWQNVWDELDGLSLDGKTIALFGLGDQEGYGEWFLDAMGLLHDELKATNAKFIGYWKNEGYQFDASKALTEDESHFVGLALDEDSQYDKSDERIEQWCEQVLVEYHESL

SEQ ID NO: 505 - protein, 667 aa, Cryptococcus neoformans var. neoformans JEC21
MTTMSSDVPNSPTSTSFTGTFSPAATAANTAANARTRDAPSPTTSSSGPKLETNKDQRLIVVSNRLPVTISKDDNGEYHFKMSSGGLVSALSGCKKTMSFTWIGWPGKDIPMQDRETVNRRLLEEYNCYPVYLSDELADSHYNGFSNSILWPLFHYHPGEMNFDSAHWLAYREANMRFADVVSSLVQAGDMVWVQDYHLMLLPMLLRSMITGESAQGEMVRQELGRVKEGVDDTVVKEVLKMGPGVAQAEDEGVEMLDDVEEEGGEMDVKTSPKRPHYGRGMSTFQKQELVAKEKGKEGIRIGFFLHTPFPSSEIYRILPVRREILLGVLQCDLIGFHTYDYARHFLSSCTRILGLETQPNGIEFDGRYCQVGTYPIGIDPNQFIEGLQKESIVKRLRSLEARFDGVKVIIGVDRLDYIKGIPQKLQALETFLTQHPEWIGKVVLVQLAIPSRQDVEEYQDLRACVNELVGRINGRFGTVESVPIHYMHKSVPFEELTAMYALADACLVTSTRDGMNLVAYEYISSQAERHGSMILSEFAGAAQSFNGSLLINPWDVQSTADAINQALTLSPQQRKTNWQKLFNYVSKYTAEAWGVSFVNELNRLSGQRPAGPTGLAGRRKSGSLSRTSSKASMQRRKSSQSGIATGLGAAAGAAVNWAQAQVGTQT

SEQ ID NO: 506 - protein, 403 aa, Streptococcus agalactiae 2603V/R
MKIFDKSMKLEHVAYDIRGPVLEEADRMRANGEKILRLNTGNPAAFGFEAPDEVIRDLITNARESEGYSDSKGIFSARKAVMQYYQLQNIHVDMDDIYIVNGVSEGISMSMQALLDNDDEVLVPMPDYPLWTACVSLAGGNAVHYICDEEANWYPDIDDIKSKITSKTKAIVLINPNNPTGAVYPREILQEIVDIARQNDLIIFSDEVYDRLVMDGMEHIPIASIAEDIFTVTLSGLSKSHRICGFRVGWMVLSGPRQHVKGYIEGLNMLANMRLCSNVLAQQVIQTSLGGQQSIDSMLLPGGRIYEQRNYIHKAINEIPGLSAVKPNAGLYLFPKIDTDMYRIDNDEEFVLNFLKQEKVLLTHGRGFNMNTADHFRIVYLPRVDELTELQEKMARFLSQYKR

SEQ ID NO: 507 - protein, 719 aa, Cryptococcus neoformans var. neoformans JEC21
MTTMSSDVPNSPTSTSFTGTFSPAATAANTAANARTRDAPSPTTSSSGPKLETNKDQRLIVVSNRLPVTISKDDNGEYHFKMSSGGLVSALSGCKKTMSFTWIGWPGKDIPMQDRETVNRRLLEEYNCYPVYLSDELADSHYNGFSNSILWPLFHYHPGEMNFDSAHWLAYREANMRFADVVSSLVQAGDMVWVQDYHLMLLPMLLRSMITGESAQGEMVRQELGRVKEGVDDTVVKEVLKMGPGVAQAEDEGVEMLDDVEEEGGEMDVKTSPKRPHYGRGMSTFQKQELVAKEKGKEGIRIGFFLHTPFPSSEIYRILPVRREILLGVLQCDLIGFHTYDYARHFLSSCTRILGLETQPNGIEFDGRYCQVGTYPIGIDPNQFIEGLQKESIVKRLRSLEARFDGVKVIIGVDRLDYIKGIPQKLQALETFLTQHPEWIGKVVLVQLAIPSRQDVEEYQDLRACVNELVGRINGRFGTVESVPIHYMHKSVPFEELTAMYALADACLVTSTRDGMNLVAYEYISSQAERHGSMILSEFAGAAQSFNGSLLINPCMPAFLLLHATVIEADLFFVFLGDVQSTADAINQALTLSPQQRKTNWQKLFNYVSKYTAEAWGVSFVNERAFSVFSLFLSYFNRIDLYKVLTAPSFISVVNRLSGQRPAGPTGLAGRRKSGSLSRTSSKASMQRRKSSQSGIATGLGAAAGAAVNWAQAQVGTQT

SEQ ID NO: 508 - protein, 493 aa, Panus rudis
AIGPVTDLHIVNDNIAPDGFTRAAVLAGGTFPGPLITGNKGDNFRIDVIDDLTEESMLKSTSIHWHGFFQKGTNWADGPAFVNQCPITTGHSFLYNFNVPDQAGTFWYHSHLSTQYCDGLRGAFVVYDPNDPHADLYDVDDDSTVITLADWYHTLARQITGVPTPDATLINGLGRSASGPQDSELAVITVEQNKRYRLRLVSISCDPNYIFSIDSHNFTIIEVDGVNSKPLTVDSAQIFAAQRYSVVLNANQPVGNYRIRARPNNGDTTFTNGRNSAILRYKGATVEEPATITPPVSQTPLIEANLKPLASMPVPGTHTPGVADVVKPLQFGFNPPAFTINGASFVPPTVPVLLQILSGAKTAQEIVPSGSIIELPLNSVVELSFPNPTGAPGGPHPFHLHGHTFFVVRSAGQTTYNYDDPIARDVVSTGTAGDNVTIRFATDNAGPWFLHCHIDWHLDAGFAVVMAEGINQTQAANPTPDAWNQLCPTYDAL

SEQ ID NO: 509 - protein, 154 aa, Buchnera aphidicola str. Sg (Schizaphis graminum)
MKKIGIFFGSDTGNTEKAAELIHKKIGSNISMLYDISNVSKKDFESFDHLILGVPTWYYGEIQCDWDDFLPILKKINFLHKTVALFGCGDQEDYAEYFCDALGLIYQVLKKNNAKIVGKWPTIEYNFESYKALLNKDYFVGLVLDEARQPEKTE

SEQ ID NO: 510 - protein, 486 aa, Geobacter sulfurreducens PCA
MGERILVVSNREPYIHIRTGDTVEVHRPASGLVTAVEPVMRACSGTWIAHGSGSADRETVDSHDRVRVPPHKPEYNLRRIWLTKEEEEGYYYGFANEGLWPLCHIAHVRPVFRTSDWQQYVRINQRFADAVVKEADSDDPVVLVQDYHFALLPAMIRKALPKATIITFWHIPWPNPESFGICPWREELLKGMLGSTILGFHTPYHCKNFLETVDRYLETRIEHESSTISRRGQLTMVESYPISIQWPPAWQGTLPPVDVTRSEILGELGLPLDHLIGVGVDRMDYTKGIPERFMAVERLFELHPELVGRFTFVQIAAPSRSALEEYQAFEARVHSHAERINGRFSRDGRPAIILKAEHHEPEQVNRYYRAADVCMVTSLHDGMNLVAKEYVAARDDERGALVLSQFTGAAHELHEALIVNPYHVEQTAEALHRALTMPDYEQRERMRSMRMLVRDFNVYRWAGRMLLDAARVRQREKLAARIGGES

SEQ ID NO: 511 - protein, 169 aa, Synechococcus sp. CC9311
MAYTIFFATSTGKTEDVADKLKDLLPGTESKDVDSIGSAAELAEAEALICCVPTWNTGADEGRSGTAWDTYAEEIPSMDFSGKSVAIVGLGDSSSYSDYFCDAMEELYTAFVQAGANLIGKVPTDGYTFAESKSVIDGKFCGLAIDEDNESDLTDQRLSDWVKQINSEA

SEQ ID NO: 512 - protein, 620 aa, Physcomitrella patens subsp. patens
MDELNCELWHACAGPLTQLPPVDSLVMYWPQGHIEQVRAADVYQASKQFSNLPAHLLCRISKIELQADPQTDEVFAQMDLTPQYELSKETKDAPSPIQQSNVRSFCKTLTASDTSTHGGFSVPRRAAEECLPLLDHNMVPPCQELVAKDLHGKDWSFRHIYRGHPRRHLLTTGWSVFVSQKRLVAGDTVIFLRGENGQLRVGVRRASKQQPQARSTHFSSANLHLGVLAAASHAATERLRFSVIYNPRTSPSEFVIPYHKYLRSEDNNLTVGSRFKMKFETEESTERRYSGTIVEISDVDPLKWPSSAWRSMKVEWDESASERHERVSPWEIEPLVPISTLPTPPVGPRPKRRPPTFDSSVSWASYMGTGAYQFRDPSCNKILPSWLTNSKSANLTSPPVPARSQLPITSLNNDPKVLHAHNLSFELWETVEQEQLNASPALEQQCKLFGFNLADKVVPTPVSSAPSLCEDSEGSGPWSSSDHTSSTSADTRVGMIVTGTYQPLVAPVRSGTKVYYSGKVGRTIDLKKCESYAALRRMLASLFGLEGQLDDVTKGWQLVYTDHENDVLLVGDDPWEEFCNCVRSLKVLSPQDAAGQSVGKYPMTNCDEDDDWQSAVQSSG

SEQ ID NO: 513 - protein, 500 aa, Synechococcus sp. PCC 7002
MKSSLVILYHREPYDEVRENGKTFYRDKTSPNGIMPTLKSFFANAEQSTWVAWKQISGKQQENFQAKMAFPGQENSVVHRIPLSADQVKNFYHITSKEAFWPILHSFPWQFTYDSSDWENFKQINEMFAEAACEDADDDALFWVHDYNLWLTPYFIRQKKPNAKIAFFHHTPFPSVDIFNILPWREAIVDSLLCCDLCGFHLPRYVQNFVAVARSLRKVEITRQVPVDEHAFTAVGTALAEPEITTQLKYKDHLVNLDAFPVGTNPTQIRAQVEKASTQERIRKIREELGSNKLILSAGRVDYVKGTKEMLVCYERLLERRPELQTKVNLVVAAAKAASGMRVYKNAQSEIERLVGRINGRFANLNWTPILLFTSALSYEELLGFFGAADIAWITPLRDGLNLVAKEYVVAHGCDDGVLILSEFAGSAVELPDAILTNPYAAKRMDESIDQALAMPVEEQQRRMKSMYQAIQRYDVQQWANHMFREAKATAVLGKEPTPV

SEQ ID NO: 514 - protein, 183 aa, Glycine max
MDGGGYNLTTTSLSSSMEQVMRPKSPLPGLVDFHGKRKQMVKIQVLEREIGLLQEELKSLEGLNPASRCCKELDAFVDSVSDPFTPTRKQTVSKSHHFRRQMISLPRVCCSNSCLLHKKTAKGCCWDCCSSSNSKCCHCCGCCCCCLKSASRSCAQKLLLECAFSCEPSFSLCEELLSYTRYQ

SEQ ID NO: 515 - protein, 520 aa, Trametes versicolor
MSRFHSLLAFVVASLAAVAHAGIGPVADLTITNAAVSPDGFSRQAVVVNGGTPGPLITGNMGDRFQLNVIDNLTDHTMLKSTSIHWHGFFQKGTNWADGPAFINQCPISSGHSFLYDFQVPDQAGTFWYHSHLSTQYCDGLRGPFVVYDPNDPAADLYDVDNDDTVITLADWYHVAAKLGPAFPLGADATLINGKGRSPSTTTADLTVISVTPGKRYRFRLVSLSCDPNHTFSIDGHNMTIIETDSINTAPLVVDSIQIFAAQRYSFVLEANQAVDNYWIRANPSFGNVGFTGGINSAILRYDGAAAIEPTTTQTTSTEPLNEVNLHPLVATAVPGSPAAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 516 - protein, 175 aa, Cyanothece sp. PCC 7424
MSKIGIFYGSTSGITEEIAQKLRVLFGEQLCDIYSMEEDFDEYGQLLDYDYLLLGCSTWGAGEVQNDWREPLFEMELEKPDFTGKTIALFGAGDQVSHGQDFVSALGTLYQHFQKLGATLVGDYPTDGYDFKHSNALHDGKFVGLPIDEINQSELTEERINQWVESLRPVFIGSN

SEQ ID NO: 517 - protein, 215 aa, Zea mays
  misc_feature (99)..(99): Xaa can be any naturally occurring amino acid
  misc_feature (199)..(199): Xaa can be any naturally occurring amino acid
  misc_feature (207)..(207): Xaa can be any naturally occurring amino acid
DSRGIPGIRKEVADFIHKRDGYPSDPELIYLTDGASKGVMQILNTIIRNEMDGILVPVPQYPLYSATISLYGGSLVPYYLEEEANWSLDFVNIRQTVAXRAMVMINPGNPTGQCLSEANIKELLQFCYHENLVLLADEVYQQNIYQDERPFISARKVMFDMGPPISSELQVVSFHTVSKGYWGECGQRGGYFEMTNLPXKTVDEIYXVASIALSP

SEQ ID NO: 518 - protein, 177 aa, Dechloromonas aromatica RCB
MAKIGIFFGTDTGRTRLIAKQIAKKLGDAADVPVNIGRVTLADFLAYDALIVGSPTLGDGELPGQSVGLNQPSWEEFLPQLADADLTGKTVAIFGLGDQKKYAEEFVDAIRLLHDAFADAGARMVGRWPTEGYEFKASQAVDGDEFVGLALDQHHQPVLTEERIDRWLAQITPELLP

SEQ ID NO: 519 - protein, 485 aa, Oryza sativa Japonica Group
MFGGGGGGGRKPLDYEELNENVKKVQYAVRGELYLRASELQKEGKKIIFTNVGNPHALGQKPLTFPRQVVALCQAPFLLDDPNVGLIFPADAIARAKHYLAMAPGGLGAYSDSRGIPGIRKEVAEFIERRDGYPSDPELIYLTDGASKGVMQMLNTIIRNERDGILVPVPQYPLYSAAISLFGGSLVPYYLEEEANWGLDFVNLRQTVASARSKGITVRAMVIINPGNPTGQCLSEGNIKELLKFCFHENLVLLADEVYQQNIYQDERPFISARKVLFDMGPPMSREVQLVSFHTVSKGYWGECGQRGGYFEMTNLPPKTVDEIYKVASIALSPNVPGQIFMGLMVNPPKPGDISYLKFSAESKSILESLRRRARLMTDGFNSCRNVVCNFTEGAMYSFPQIRLPPKAIDAAKRAGKAADVFYCLKLLEATGISTVPGSGFGQKEGVFHLRTTILPAEEDMPAIMTSFKKFNDTFMDQYDGYSRM

SEQ ID NO: 520 - protein, 420 aa, Bifidobacterium longum DJO10A
MPTAKPASLSAEALNIPRSGIRDVFDRVERVPDAISLTVGEPSATAAPHIVAAACEAAQAGRTRYTNVLGVPEYRKAVADYSARVKGLTYDPETEIQAVDGATIGLFLALKAVVGTGDEVIIPSPFFTSYDAEVMLCGGRPVTVALRPEHGMRVNAADIEAAITPRTRAVIINSPGNPTGAVTSAAELARIAEVCKQHNIWAISDEVYHPFVFGETFGETLGGEAAVAPSIAAVPGMKDRTIVVESLSKTYAMTGWRIGYLLAPEAVIEQTGKIAELMHSSVNSLAQYAGVAALAGPQDHVAAMREEYRAKRQIVLDGLAGCPVLRLIEPQGAFYAFVDVRLTGLDSGEFADRLLDEEHVAVVPGEAFGEEGRGFVRLSYAGDAGELREGVARLRAFAERVWNPITGHHTATYHPMEVLA

SEQ ID NO: 521 - protein, 170 aa, Synechococcus sp. PCC 7002
MSKIGLFFGTQTGNTEELAQAIQAAFGGSDIVELFDVAEVDIEALRDFDQLIIGCPTWNVGELQSDWEALYDDLDDVDFSGKTIAYFGAGDQVGYADNFQDAMGVLEEKITSLGGKTVGQWPTAGYDHSESKAERDGKFVGLAIDEDNQPELTAERIQAWVAQLKPAFGL

SEQ ID NO: 522 - protein, 641 aa, Gibberella zeae PH-1
MGFWKRLTEFLFVGGGYNDQFRFTSDHSLVDPVNSVVDVFDPSTVVGGSCNTPTNRSCWAPGLDIYTDYEEVIPEGEVRKFHLVVGNHQISPDGYLVERMLFNGSYPGPTLEGNWGDTFEITIHNNLTNFNGTSVHWHGIRQLNTNWMDGVSGVTECPIPPGETMTYRWKATQYGTSWYHSHFSLQYADGLLGAIKINGPSSMNYDYDLGPVLITDHFHKTAFSQVMLEYLGRPPAPDSILMNGNGTYYCCPKGNKNCDNNCVGKSKLTSFNFEKGKKYKMSLVNTGVSTHMTFWIDNHNFSVVATDFVPITPYNTSILNIAIGQRYDIIIEANATLHDSANSKRTNFWMHARDCNNGGARSNLGIIRYDAKNQKVPWTPPPDEKHLCYGCLDELGVNLKPIVKRTVPLAANVNYQNESFKVHLVGYPDDTAESSTLHKWVLKDSSFYLDWAEPSLSLVKVAYEKDWKHPKWPKGYEPVNLEYTNGSWVYFLIEGKFKESLHNMPGHPKIYKTQAPVAHPMHIHGHDFVVLASGDKEFDASTVKLNTNNPPRRDVALLPVNGYLVVAFQMNNPGVWLMHCHIAWHASGGLALQFVESPRQIGPQFQKSGILPHYSEQCNNWAAYYTMFNKNENATQEDSGI

SEQ ID NO: 523 - protein, 263 aa, Glycine max
  misc_feature (215)..(215): Xaa can be any naturally occurring amino acid
  misc_feature (231)..(231): Xaa can be any naturally occurring amino acid
  misc_feature (233)..(235): Xaa can be any naturally occurring amino acid
  misc_feature (238)..(238): Xaa can be any naturally occurring amino acid
  misc_feature (241)..(241): Xaa can be any naturally occurring amino acid
  misc_feature (243)..(245): Xaa can be any naturally occurring amino acid
  misc_feature (247)..(248): Xaa can be any naturally occurring amino acid
  misc_feature (250)..(250): Xaa can be any naturally occurring amino acid
  misc_feature (252)..(253): Xaa can be any naturally occurring amino acid
MRKSAADRFRHLFNRSLILLRHRHHHHPFPSSSSLSPFSRSRFFSSTPFSMASDSPFPVTAQNINPKVLKCEYAVRGEVVTLAQNLQKDLQANPGSHPFDEILYCNIGNPQSLGQQPITFFREVLALCDHPAILDKSETQGLFSTDAIQRAWQIVDQIPGRATGAYSLSQGVKGLRDTISAGIEERDGSPANPDDIFMTEGASPAVHNMMQLLIXSENDGILRPIPQYPLXSXXXALXGRXLXXXYXXEXSXXGGEIPNQGAR

SEQ ID NO: 524 - protein, 403 aa, Pseudomonas syringae pv. syringae B728a
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAVHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPILNDEKFVLDLLLSEKLLVVQGTAFNWPYPDHFRVVTLPRVDELEQAIGRIGNFLKGYRQ

SEQ ID NO: 525 - protein, 173 aa, Vibrio angustum S14
MKIGLFYGSTTCYTEMAAEKIRDCIGPELIELRNIKEADINEMNQFDMLILGISTWDFGELQEDWEAVWQQLDGLRLTNKTIALFGLGDQEGYTEWFLDAMGMLHDKLLEAGVQFIGYWPNDDSYQFEASKALTEDKQFFVGLALDEDSQYEHSDQRITQWCEQIMLEYAETL

SEQ ID NO: 526 - protein, 899 aa, Oryza sativa Japonica Group
MMSRSYTNLLDLAAGNFEALGPAGGGRRRSFGAKRMTRVMTVPGTLSELDDEDDEPAATSSVASDVPSSAACERLIVVANQLPVVARRRPGAAAGGWAFSWDDDSLLLRLRDGVPDEMEVLFIGTLRADVPACEQDEVSQSLIDGFGCAPVFLPAGLYDRFYQHFCKGYLWPLFHYMLPFASALPAAASGDGRFDRGAWEAYVLANKYFFEKVVEVINPEDDYVWVHDYHLMALPTFLRRRFNRLRIGFFLHSPFPSSEIYRSLPVREEILRTLLNCDLIGFHTFDYARHFLSCCSRMLGIEYQSKRGYIGLDYFGRTVGIKIMPVGIHMGQLQSVLRLSEKEKKVAELRQQFEGKSVLLGVDDMDIFKGINLKLLAFENMLRTHPKWKGRAVLVQIANPARGKGKDLEAVQAEIRESCDRINKEFGQSGYSPVIFIDQSVPSAVRLAYYTVAECVVVTAVRDGMNLTPYEYIVCREGIPGSECAPEVSGPKKSMLVVSEFIGCSPSLSGAIRVNPWNIEATAEALNEAISMSEREKQLRHEKHYRYVSTHDVAYWSKSFVQDLERACKDHFRKPCWGIGLGFGFRVVALDPHFTKLNFDSIIMSYERSKSRAIFLDYDGTLVPQASLNKNPSEELLRIINTLCADRNNTVFIVSGRSKDDLSKKLISCPKLGIAAEHGYFLRWTRDEEWQTTAQTSDFGWMQMAKPVMDLYTESTDGSTIETKETALVWHHQDADQGFGSSQAKEMLDHLESVLANEPVSVKSGQFIVEVKPQGVTKGLIAEKVLTSMKEKGQLADFVLCIGDDRSDEDMFENIADVMKRSIVAPKTPLFACTVGQKPSKARFYLDDTFEVVTMLSSLADASEPDLMADLEDDLATSVSSIEISDRVVSFSNLRTEGS

SEQ ID NO: 527 - protein, 500 aa, Mycobacterium marinum M
MGPGGRQSAEPASTEVFGDSDFVVVANRLPVDQERLPDGTIAWKRSPGGLVTALEPLLRRRRGAWVGWAGVVENDVDVQDEPIVQDELQLQPVRLSADDVAQYYEGFSNATLWPLYHDVIVRPIYHREWWDRYVDVNRRFAEATARAAARGGTVWVQDYQLQLVPKMLRAMRPDLTIGFFLHIPFPPVELFMQLPWRTEIIQGLLGADLVGFHLPGGAQNFLILSRRLVGADTSRGTVGVRSRFGEVILGSRTIRVGAFPISIDSGALDQTARDRNIRRRSREIRAELGNPRKILLGVDRLDYTKGIDVRLKAFSELLAEGRVKRDDTVLVQLATPSRERVESYQTLRNDIERQVGHINGEYAEVGHPVVHYLHRPVPRNELIAFFVASDVMLVTPLRDGMNLVAKEYVACRSDLGGALVLSEFTGAAAELRHAYLVNPHDLEGVKDGIEEALNQTEEAGRRRMRSMRRQVLAHDVDRWARSFLDALADSRPNDSADAAD

SEQ ID NO: 528 - protein, 515 aa, Zea mays
  misc_feature (98)..(98): Xaa can be any naturally occurring amino acid
  misc_feature (146)..(146): Xaa can be any naturally occurring amino acid
  misc_feature (390)..(390): Xaa can be any naturally occurring amino acid
MARRRPMDYEELNEKVKKAQYAVRGELYLRASQLQKEGKKIIFTNVGNPHALGQKPLTFPRQVRVAISSASHPHGVGCSTTPSLLSYPDGTSSRSRAXVVALCQAPFLLDDPHVGLMFPADAIARAKHYLAMAPGGLGPYSDSRGXPGIRKEVADFIHKRDGYPSDPELIYLTDGASKGVMQILNTIIRNEMDGILVPVPQYPLYSATISLYGGSLVPYYLEEEANWSLDFANIRQAVAEARSKGISVRAMVMINPGNPTGQCLSEANIRELLRYCYHENLVLLADEVYQQNVYQDERPFISARKVMFDMGPPISREVQVVSFHTVSKGYWGECGQRGGYFEMTNLPPKTVDEIYKVASIVLSPNVPGQIFMGVMVNPPKPGDISYPKFXAESKSILESLRRRARMMTDGFNSCRNVVCNFTEGAMYSFPQIQLPARAIEAAKRAGKAADVFYCLKLLEATGISTVPGSGFGQKEGVFHLRTTILPAEEDFPTIMSSFKKFNDSFMEQYEGYSRM

SEQ ID NO: 529 - protein, 518 aa, Rigidoporus microporus
MFRFNTFSTLIPLALSLGVRAAIGPVADLHISNANISPDGFTRAAVLAGGSFPGPLITGNKGDNFQINVINDLTDADQLKTTTIHWHGFFQHGTNWADGPAFINQCPIASGNSFLYNFQVPDQAGTFWYHSHLSTQYCDGLRGAFVVYDPDDPHASLYDVDDESTVIALADWYHGLARLGPKFPTTNSTLINGLGRYDFGPSSDLAVISVQAGKRYRFRLVSISCDSNYVFSIDEHTFTVIEVDGVNHQPVDADSLQIFAGQRYSIVVNADKSEGGNYWIRASPTPGPQGFANGINSAILRYVGSDEVEPTTNQTTSTNPLVEANLVPLENPGAPGDPTPGGVDVPLNLAVAFDGTGLDFQVNGQTFIPPTVPVLLQILSGAQSATDLLPSGSVYVLPSNATVEISIPAGAVGGPHPIHLHGHTFDVVRSAGSSTYNYVNPPRRDVVSIGNAGDNVTIRFRTDNPGPWFLHCHIDWHLEAGFAVVFAEDIPNVASVNSPPQAWSDLCPIYDALDPSDH

SEQ ID NO: 530 - protein, 567 aa, Arabidopsis thaliana; identical to SEQ ID NO: 157

SEQ ID NO: 531 - protein, 172 aa, Pectobacterium atrosepticum SCRI1043
MKIGLFYGSSTCYTEMAAEKIRDMLGEELVDLHNVKDVEPQRMEDYSTLILGIPTWDFGEIQEDWENIWGQLATLNLKGKVVALYGMGDQLGYSEWFLDALGMLHEQLLPLGVTFIGYWPIDGYEFTSPKPLTTDGKHFVGLALDEVNQYDLSDERLEQWCEQILQEMASLL

SEQ ID NO: 532 - protein, 526 aa, Trametes versicolor
MGKFHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHEALDVDSIQIFAGQRYSFILNANQSIDNYWIRAIPNTGTTDTTGGVNSAILRYDTAEDIEPTTNATTSVIPLTETDLVPLDNPAAPGDPQVGGVDLAMSLDFSFNGSNFFINNETFVPPTVPVLLQILSGAQDAASLLPNGSVYTLPSNSIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTAWSDLCPTYDALDSSDL

SEQ ID NO: 533 - protein, 342 aa, Oryza sativa
  misc_feature (255)..(255): Xaa can be any naturally occurring amino acid
  misc_feature (261)..(261): Xaa can be any naturally occurring amino acid
MLRNNLVFGNRAAAMVLVTNTRLAQTTTSNSMFWKSKQKEASTHTNMNGNKDSQHFLTLDNLSPAVKNVQYAVRGKVVIRAGEIEKDLKSGTSKPFDRVIRANIGDCHATGQKPITFLRQVMALCAYPALLSSNEFPQDAKDKAQKWLNACAGGSVGSYTDSAGLEAVRKSIAEFITRRDGGIAASPDNIFLTTGASAGIKIVMEMLLNGPNQKPTGFMIPIPQYPLYSATISEYSSESVGYYLDEGHNWALDVXELERAXQESLSRCEPRAICIINPGNPTGQGALAREHEGHQSMGVSKRGFSFFPAQVYQKNPFPRGRQFPSVKKGGRWVWGGAPLQKR

SEQ ID NO: 534 - protein, 173 aa, Chondrus crispus
KIGIFFSTSTGNTTEVADFIGKTLGAKADAPIDVDDVTDPQALKDYDLLFLGAPTWNTGADTERSGTSWDEFLYDKLPEVDMKDLPVAIFGLGDAEGYPDNFCDAIEEIHDCFAKQGAKPVGFSNPDDYDYEESKSVRDGKFLGLPLDMVNDQIPMEKRVAGWVEAVVSETGV

SEQ ID NO: 535 - protein, 778 aa, Physcomitrella patens subsp. patens
MEVIYIGCLKVEVDDSEQDEVAATLLENFNCVPAFLPLDVRTRFYHGFCKQMLWPLFHYMLPLSPEHEGRFNRSFWQAYVSVNKVFADKVMEVISPDDDYVWIHDYHLMVLPTFLRKRFNKVRLGFFLHSPFPSSEIYRTLPVRDEILRALLNADLIGFHTFDYARHFLSCCSRMLGLEYESKRGYIGLEYYGRTVGIKILPVGIHMEQLNAGLALADTEWRISELRTQYKNRTVFLGVDDMDIFKGIGLKFLALEQLLRQHPKLRNRVVLVQIANPARGRGRDIKDLQNEAYTIAQRINDEFGNEAEGYTPVVLLQRSVPFYERIAYYTIAECCVVTAVRDGMNLIPYEYIACREGSPDLDAVVDHGPGPAPLKKSMLIVSEFIGCSPSLSGAIRVNPWNIEALAEAMNMSITLPDIEQHMRHEKHFRYVNTHDVAYWARSFMTDLERTCKGHARRRCYGTGFGLGFRVVALDPDFRRLRTDLIVSAYKKSMSRAILLDYDGTMIPQASINNPMPTPEVLAMLKTLCNDPKNFVVIVSGRPRDILNECFSSCEELGLAAEHGFFYRWHRDEEWVTCRYQREDFDDHENDHMEWKEIVEPVMQQYTESTDGSYIEQKESAMVWHHRDADPDFGSWQAKELQDHLESVLANQPVTVKSGAHIVEVKPQGVSKGVVVEELLAMMALKSAAPDFVLCVGDDRSDEDMFESIATATARSGLAEVFACTVGQKPSKAKYYLDDIAEVIKLLQGLAAASDPGATPSGLPSATSSQVSLETSLHI

SEQ ID NO: 536 - protein, 437 aa, Mycobacterium leprae TN
MTLYQQISVDGSGTMSDVTTHQLPMHTPGYHRQRAFAQSSKLQDVLYEIRGPVSQHATRLETEGHRILKLNIGNPALFGFDAPDVIMRDMIQALPYAQGYSDSQGILPARRAVVTRYELVDGFPRFDVDDVYLGNGVSELITMTLQALLDNGDQVLIPSPDYPLWTASTSLAGGTPVHYLCDETQGWQPDIADVESKITERTKALVVINPNNPTGAVYSNEILNQIVDLARKHQLLLLADEIYDKILYDDTKHISVASIAPDLLCLTFNGLSKAYRVAGYRSGWLAITGPKDHASSFIGGINLLANMRLCPNVPAQHAIQVALGGHQSIEDLVLPGGRLLEQRDVAWTKLNEIPGVSCVKPTGALYAFPRLDPEVYGIVDDEQLVLDLLLQEKILVTQGSGFNWPAPDHLRLVTLPWSRDLAAAIDRLGNFLVSYRQ

SEQ ID NO: 537 - protein, 603 aa, Gibberella zeae PH-1
MLVIERSDQIRWMSISRQEHKLTRYVNVASSLLSVIVLLLNNPKLLALSLTPLSTGDLRLSALRQLPVRMPETVGENGNAAPGRLLLLSNRLPITIKRSEDGSYSFSMSSGGLVTGLSGLSKTTSFQWYGWPGLEVPDNEVEGMKQRLKEEYGAHPVFIDDELADRHYNGFSNSILWPLFHYHPGEITFDESAWAAYQEVNRLFAKTVIKDVQDGDLIWVHDYHLMLLPQMLREEIGESKKNVKIGFFLHTPFPSSEIYRILPVREALLTGLLDCDLIGFHTYDYARHFLSSCSRILECPTTPNGVDWNGRFVTVGAFPIGIDPDNFVEGLKKPKVQERIAALSRKFEGVKLVVGVDRLDYIKGVPQKLHALEVFLTEHPEWIGKIVLVQVAVPSRQDVEEYQNLRAVVNELVGRINGKFGTIEFMPIHFLHQSVNFDELTALYAVSDVCLVSSTRDGMNLVSYEYIATQQKNHGVMILSEFTGAAQSLNGSLIVNPWNTEELANALHDAVTMSPEQREANYKKLERYVFKYTSAWWGASFVAEMTRLSAEGSQPKTLRNVSGAVIGLEQKAQQIVTGLEKKADELLSGNEKNETETSEEPSQ

SEQ ID NO: 538 - protein, 167 aa, Fusobacterium nucleatum subsp. vincentii ATCC 49256
MKTVGIFFGTTGGKTQEVADIIAAKLGDAQVFDVANGVAEMEVFDNIIMASPTYGAGELQDDWASAIDEVADMDFSGKVVALVGVGDAAIFGGNYVEALKHLYDAVQPKGAKIVGFTSTDGYDFEASEAVIDGDKFMGLAIDASYDTDEITSKVEDWIENKVKDELL

SEQ ID NO: 539 - protein, 146 aa, Desulfovibrio salexigens
MSKSLIVYGSTTGNTETAAEYVAEAFENKEIDVELKNVTDVSVADLGNGYDIVLFGCSTWGEEEIELQDDFIPLYDSLENADLKGKKVSVFGCGDSDYTYFCGAVDAIEEKLEKMGAVVIGDSLKIDGDPERDEIVSWGSGIADKI

SEQ ID NO: 540 - protein, 539 aa, Coprinopsis cinerea
MFKNLLSFALLAISVANAQIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVVYDDNDPHAALYDEDDENTIITLADWYHIPAPSIQGAAQPDATLINGKGRYVGGPAAELSIVNVEQGKKYRMRLISLSCDPNWQFSIDGHELTIIEVDGRLTEPHTVDRLQIFTGQRYSFVLDANQPVDNYWIRAQPNKGRNGLAGTFANGVNSAILRYAGAANADPTTSANPNPVQLNEADLHALIDPAAPGIPTPGAADVNLRFQLGFSGGRFTINGTAYESPSVPTLLQIMSGAQSVNDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTVVRRAEPTGFSAKFRREGL

SEQ ID NO: 541 - protein, 512 aa, Trametes villosa
MSFSSLRRALVFLGACSSALASIGPVTELDIVNKVIAPDGVARDTVLAGGTFPGPLITGKKGDNFRINVVDKLVNQTMLTSTTIHWHGMFQHTTNWADGPAFVTQCPITTGDDFLYNFRVPDQTGTYWYHSHLALQYCDGLRGPLVIYDPHDPQAYLYDVDDESTVITLADWYHTPAPLLPPAATLINGLGRWPGNPTADLAVIEVQHGKRYRFRLVSTSCDPNYNFTIDGHTMTIIEADGQNTQPHQVDGLQIFAAQRYSFVLNANQAVNNYWIRANPNRANTTGFANGINSAILRYKGAPIKEPTTNQTTIRNFLWETDLHPLTDPRAPGLPFKGGVDHALNLNLTFNGSEFFINDAPFVPPTVPVLLQILNGTLDANDLLPPGSVYNLPPDSTIELSIPGGVTGGPHPFHLHGHAFSVVRSAGSTEYNYANPVKRDTVSIGLAGDNVTVRFVTDNPGPWFLHCHIDFHLQAGLAIVFAEDAQDTKLVNPVPEDWNKLCPTFDKAMNITV

SEQ ID NO: 542 - protein, 177 aa, Pantoea agglomerans
MATIGIFFGSDTGQTRKVAKLIHQKLDGIADAPLDVRRATREQFLSYPVLLLGTPTLGDGELPGVEAGSQYDSWQEFTNTLSEADLTGKTVALFGLGDQLNYSKNFVSAMRILYDLVIARGACVVGNWPREGYKFSFSAALLENNEFVGLPLDQENQYDLTEERIDSWLEKLKPAVL

SEQ ID NO: 543 - protein, 537 aa, Brassica napus
  misc_feature (285)..(285): Xaa can be any naturally occurring amino acid
MRRFVIGQAKNLIDQTRRRPRPHHNNIRLLSLLASDPIPVSSSRFFSDMTGSDSSSSLPVTLDSINPNVLKCEYAVRGEIVNIAQKLQDDLKINKDAYPFDEIIYCNIGNPQSLSQQPITFFREVLALCSHTALLDRDETHALFSADSIARAWKILDQIPGKATGAYSHSQGIKGLRDAIAAGIEARDGFPADPNDIFMTDGASPGVHMMMQLLISSEKDGILCPIPQYPLYSASIALHGGSLVPYYLDEASGWGLEISELKKQLEDAKSKGITVRALAVIQPGXPTGQVLAEENQREIVDFCKKEGLVLLADEVYQENVYVPDKKFHSFKKVARSMGYGEKDICLVSFQSISKGYYGECGKRGGYMEVTGFTSDVREQIYKVASVNLCSNISGQILASLVMSPPKPGDESYESYIAEKEGILSSMARRAKTLEEALNKLEGITCNRAEGAMYLFPCINLPQKAIAAAEAAKTAPDTFYCKRLLNATGIVLVPGSGFRQVPGTWHFRCTILPQEDKIPAIVNRLTEFHKSFMDEFRD

SEQ ID NO: 544 - protein, 648 aa, Nicotiana tabacum
MVDLLGSNSQLKHFEGDNALCREIWRACSGSLLDVPKLGERVHYFPRLHMDQLEQSSNLEWIQGLQLSHLPRKILCRVLHIRLLVEHDTEEVYAETILLPNQEQNEPSTPEFCPLEPPRPQYQSFCKALTTSDIKSNWGLSVHRKDANKCFPPLDMMQEKPTQELIVNDLQGNEWRFKHVFQGQPRRHLLKHGWSTFVTSKKLLAGDLVVFLRDETGKLHVGIRRLSYQCNSVGSSTFSRQSMEGVLAVASHAFATRSLFSVYYKPCYNRSSQFIMSLSNYFEGGNHGPGVGTISRTQHTSLDSHVKRTSGMDQMSFPQGQHKTNLLLEEDQYMQDSEAISNSARPTMMALEIGQQSVESLNNIHHIEDSVLQPHTAVARENNERFIPNETVAIQAQDENFDELFKETDFPDFVNTSLDTITLDWDSDLRSTIQDFDEWLEETNPPGLQTCSEDHSRQTSSILEQPTSSQVMSISSTPSRIPYEGPGRGDEQVPWGSYQVARRCLPILNRVVSRYPDSLVNFKVTSSIFQSVCLEILAELVYFLDNLTVMNLSKDQFNVAGQHLWDLKLSGIELGWLEKRLAHIDGAFSMENLLQRRQVVTLRMGDTLATFRQLDEELGCINKELHQLSLKVGPNPPMRFHPVLEGLL

SEQ ID NO: 545 - protein, 508 aa, Coccidioides immitis RS
MPSLESPHKEDPRLLLVSNRLPITIKRSDDGKYDSSMSSGGLVSGLSGLSKTTRFQWYGWPGLEVPEDEIEIVTKRLKDEYNAVPVFIDDELADRHYNGFSNSILWPLFHYHPGEITFDESAWNAYRDANRLFAKAIAKDVRDGDLVWVHDYHLMLLPSMLREEIGETKSNVKIGFFLHTPFPSSEIYRILPVRNELLLGVLHCDLIGFHTYDYARHFLSSCSRILGLSTTPNGVEFQGKMVSVGAFPIGIDPDKFSEGLKKEKVQKRIAQLEQKFQGVKLMVGVDRLDYIKGVPQKLHALEVFLTDHPEWIGKVVLVQVAVPSRQDVEEYQNLRAVVNELVGRINGKFGTVEFMPIHFMHKSVNFDELIALYAVSDACIVSSTRDGMNLVSYEYIATQHKRHGVLVLSEFAGAAQSLNGSIIVNPWNTEELAAAYQEAVTMSDEQRALNYSKLEKYVHKFTSAFWGQSFVSELTRISAHGEKKLLLRRSSVAPNAAADVINNDIDGH

SEQ ID NO: 546 - protein, 206 aa, Prochlorococcus marinus str. NATL1A
MYQKSILNRQENLKKTKFTLNVQSCFKIFLILNCSMTVGIYFATTTGKTEDIAERLHGLLDSAEGPKDISDVDDLSELAGHDGVICGIPTWNTGADSERSGTAWDSILEDIGELDLSGKKVAIFGLGDSSTYTENYCDAMEELHRYFQQAGASMVGYTAKTDYTFDESKSVVGEEFCGLPLDEDSESDMTDERLSGWAEKLKGEMF

SEQ ID NO: 547 - protein, 424 aa, Xylella fastidiosa Temecula1
MSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 548 - protein, 482 aa, Corynebacterium efficiens YS-314
MEELNSFVVVANRLPVDMTAHPDGTYSITPSPGGLVTGLSPVLEQHRGCWVGWPGTVDVAPDPFRTDTGILLHPVRLTASDFEGFYEGFSNATLWPLFHDLIVPPVYDVDWWHDFREVNLKFAEAVNQVAAENATVWVQDYQLLLVPGILRQMRPDLCIGFFLHIPFPNPELFRQLPWREEIVRGMLGADLIGFHLPQNADNFLSLTRQVAGTAGSHTGQPDELEVEGEAAIREVKAHVITADGRKVGVGAFPISIDTGAVEQASQSSVEALRADLGSPEIVFLGVDRLDYTKGILQRLLAFEELLESGGLDPATTVFLQVATPSRERIEHYRVSRSQVEEAVGRINGRFGRMGHPVVHYLHRSLPKDDLQILYTAADVMLVTPFKDGMNLVAKEYVAAHRSGTGALILSEFAGAADELTEAYLCNPFDLESIKRQMLAAVHDLRHNPDYAAERMRANSEQVLSHDVNVWASSFLTCLEDFK

SEQ ID NO: 549 - protein, 404 aa, Salmonella enterica subsp. enterica serovar Typhi str. CT18
MSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVNIAREHNLIIFADEIYDKILYDDAEHHSIAALAPDLLTITFNGLSKTYRVAGFRQGWMVLNGPKKHAKGYIEGLEMLASMRLCANVPAQHAIQTALGGYQSISEFILPGGRLYEQRNRAWELINDIPGVSCVKPRGALYMFPRIDAKRFNIHDDQKMVLDFLLQEKVLLVQGTAFNWPWPDHFRIVTLPREDDLEMAINRFGRFLSGYHQ

SEQ ID NO: 550 - protein, 330 aa, Gemmata obscuriglobus UQM 2246
KLIVVANREPYIHRYATDGAVEWIRPAGGLTTALDPVMQACGGVWVAHGSGDADRAVTDPSGRVGVPPDDPNYVLRRVWLTPEQEDGYYYGAANGMLWPLCHQVFARPAFDPGHWDAYRRVNQTFADAVLEEAQGGPALVFIQDYHFALLPRLLKAARPDLVTAQFWHIPWPGPEKFLVCPWARDILDGLLGNDLMGFHTQHDCNHFLECVDRALECRIDRERFAVQRGGQATTVKPFPISVDPALADEYLGDDWAARAGAIRRRHGLGDRPLIVGVDRVDYTKGIPERLRAVDRVLHRHPELRGGFHFVQVGAPSRSSIPAYGDLTAEV

SEQ ID NO: 551 - protein, 849 aa, Schizosaccharomyces pombe
MPSGAQGNTQSAAYKRIVNVSRNFQFKAALNKDTREWTFQHRSSGTALYSAIASLGDPSSPWDAVYVASPGPVQISEGNDHTVETKIDEAAVVHRSSSIVISPEDQEIFLKKATEYYRKKNIEADIVPVWGKVQRVPQAKSSSATITPSVSNKLSTAYQSIKSEALKDGPMYADSVLWDVLHYRIPTLDGYQQHNLWKNFTRWSQYFADNIVSNYRPGDLILIHDYSLFLLPRLIRKQLSDAPIVFFLHAPFCTSEVFRCLSKRAEILKGVLASNVIAMQTDSYTRHFLSTCSNVLGLETTSTHIDTSDGFRVVVFSSHVSIDVPRVYSRCNSKPVSLKIQQLKSLYPSDKKLIVGRDQLTKACGVTHKLRAFRELLIHFPKWRGHVVLIQITSLPVGNNYSNEELKKTENLVAQINSEFGSLDYTPVIHFHQLLDPDEYYALLSVANIACVSSVRDSMNTMALEYVACQQKNKGSLILSEFSGTAELLLSAYLVNPYDYSRFAETINYCLNMTEKERERRFSSLWKQATSQSSQQWIYKLINRAAYEVKALESHMTTPLLTYNILIKPYRNAKRRLFLLDYDGTLIESARNSIDAVPTDRLLRTLKRLASDSRNIVWILSGRSQKFMEEWMGDISELGLSSEHGSAIRPPLAGSWSSCAENLDLSWKDTVRDFFQYYVERTPGSYIEEKKHSISWCYQNANTTYSKFQSLECQTNLEDMLKHYDVEISPAKSFLEVHPNYLNKGSIVRRILKRSGSVDFVFCAGDDKTDENMFEVFLPTAFSNSHLIDEIDSTEYSGSHHTDDNSDANKVENVKVATFRVHIGLTDKPTLSDYHLPAPRDLGELLHNL

SEQ ID NO: 552 - protein, 506 aa, Brassica napus
  misc_feature (287)..(287): Xaa can be any naturally occurring amino acid
EQMLNQHSNWRGRAVLVQIVNPARGKGIDIDEIRGEIEGSCKRINEDFGKPGYQPIVYIDTPVSVNEIIAYYHIAECVVVTAVRDGMNLTPYEYIVCRQGLLGSESDFNGPKKSMLVASEFIGCSPSLSGAIRVNPWNVEATGEALNEALSMRDPEKQLRHEKHFRYVSTHDVAFWSRSFLQDLERICVDHFKKRCWGMGISFGFRVVALDPNFRKLSIPCIVSDYKRAKSRAILLDYDGTLMPQNSINKAPSQEVLKFLNELCEDKKNSIFIVSGRGRESLGNGFXPCENIGIAAEHGYFLKWPGTKEWETCGQSCDFGWMQIVEPVMKQYTEATDGSSIEIKDSALVWQYRDADSGFGSLQAKEMLEHLESVLANEPVAVKSGHYIVEVKPQGVSKGSVAEKIFSSMDEKGKPVDFVLCIGDDRSDEDMFEAIGNAMSKRLLCDNALVFACTGGQKPSKAKYYLDDTMEVTSMLESLAEASEASNFSMRELDEALLIFETRMLK

SEQ ID NO: 553 - protein, 930 aa, Dunaliella viridis
MLSSHAKSSSSSRNLAGMLENGGFEGEGSGSCGGSRQQARDPRRTSLSVNSGRVIIASNHLPLRVKKSSTGEWQFEFDEDALTAQAKDGVPRSHFQEVLYVGGLPVDVEPEEQENIAIKLKDLYNCCPVYLDSAVKERFYKGFCKQQLWPLFHYVLPGSPSSSQRFNVEFWQAYVKANKCFADKIVEESLTDTEFVWIHDYHLLVLPSLLRKRFNRIRAGVFLHSPFPSSEIFRTFPKREELLRSLLNADLIGFHTFDYARHFLSCCSRMLGLEHETSRGSITIDYYGRTVGIKIMPTGVNPKRYLDGFSWDEFKWRRGELEAQFKGMTVLAGVDDMDSFKGIDLKLQAFERLLEYHAEWRGKVVLVQVTNPPRSTGHDITELHAFVTNLVASINYKYGNPSTNYVPVHYLERHVPLHERMAFYSIADCVVVTATRDGMNLVPYEYIVCRQGSDTTPCAESTVESGPRDSMLVVSEFVGCSPSLSGAIRVNPWSIDSGYNGMYAAICMPLEHRRLRHQKHWRYVSQHTVAFWAQSYLMDLVRVTRNHVTMKCYGLGLGLDTFRMVALDANFRKMEESQVAATYKSSKSRVFFLDYDGTLTAGQHTSITLAPLDEVLQVLRALTAEPLNKVVLFSGRPKAELQEWFASVPNLALVAENGCYLRLGEGQTWRSHLTPGLQVADQSWVSLVVAADFGWKKMALPILQQYQESTDGSSIEAKESALVWYYKDADPDFGSWQAKELLDHLEGVLSNKPVEIVGGSSAVEIKPQGVSKGQAVEKMLGQLYGYPAIAERRSSSSRPMGRPSSDASERRPSSSRFSMSDRGPSAGSAAVQSAASSVQGGGAEAAAQQELAAAGKGPDFVLCIGDDRSDEDMFTSIEMMRASPQMMSSEVYACTVGQKPSRAPFYLNDPGEVLHLLARLVGINLPNLPL

SEQ ID NO: 554 - protein, 423 aa, Xanthomonas axonopodis pv. citri str. 306
MSTAPQKPLAIRERLSEVRYEIRGELARRARELEAQGRKLIKLNIGNPGAFGFRAPEHLQRAIADDMGRTDPYTHQQGLPEAREAIATAYARRQHPDAHPDRIFVGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNEEGVLVVPGSSFNVPYRHHFRVTLMPEAGVMRDVFARIDRALARRAEAVTKVVPLKPRSVA

SEQ ID NO: 555 - protein, 567 aa, Cryphonectria parasitica
MALRAFLSLLPALSLVTAAPSVEPYQLSKRCVNSADDRSCWGDYDLSTNYYDEAPFTNVTREYWFNIVNTTASPDGVEKIVLAVNGSIPGPTIVADWGDTVVVHVTNSMQNNGSSIHFHGIRQNFTNQNDGVASITQCPTAPGDTTTYTWRALQYGTSWWHSHFYVQAWDGVYGGIQINGPATANYDEDLGVVSMMDWDHDTADNLVLQSAVTGPPTMANGLINGMNVYTLEDNSTVGSRYEMEFTSGQRYRLRLVNTAADTHFKFTIDNHTMEVIASDFVPIQPYTTDVVNIGIGQRYDVIVTADAPSDNYWMRAIAQLACSDNDNPDNIKAIIRYSDAANSTADPTSTATADASVDECVDEPAASLVPYLAIPAGGSADVTDNFAVAVEQLAGRVDWAMGNTTFINEWGYPSIQQVYDGNNTWGESQNVIQLPQANEWVYWIVQTTMGVTHPMHMHGHDFWVLGAGTGTFDSATASLSTVNVPRRDVTMLPASGWTVIAFITDNPGVWLTHCHIAWHTSEGLAVQMVERESEIVDLIDADLMNSTCGAWNDYANKVALVQDDSGI

SEQ ID NO: 556 - protein, 176 aa, Klebsiella pneumoniae
MANIGIFFGTDTGKTRKIAKMIHKQLGELADAPVNINRTTLDDFMAYPVLLLGTPTLGDGQLPGLEAGCESESWSEFISGLDDASLKGKTVALFGLGDQRGYPDNFVSGMRPLFDALSARGAQMIGSWPNEGYEFSASSALEGDRFVGLVLDQDNQFDQTEARLASWLEEIKRTVL

SEQ ID NO: 557 - protein, 672 aa, Cryptococcus bacillisporus
MTTMPNNDVPNSPTSTSFSGTFSPAATAANTAANARSRDAPSPTTSSGPKLETNKDQRLIVVSNRLPVTISKDDNGEYHFKMSSGGLVSALSGCKKTMSFTWIGWPGKDIPMQDRETVNRRLLEEYNCYPVYLSDELADSHYNGKFSNSILWPLFHYHPGEMNFDAAHWLAYREANMRFADVVSSLVQAGDMVWVQDYHLMLLPMLLRSMITGESAQGEMVRQELGRVKEGVDDTVVKEVLKMDPGVAQAEDEGVEMLGDVEEEGGEMDVKSSPSKRPPYARGMSTFQKQEMVAKEKGKEGIRIGFFLHTPFPSSEIYRILPVRREILLGVLQCDLIGFHTYDYARHFLSSCTRILGLETQPNGIEFDGRYCQVGTYPIGIDPNQFVEGLQKESIVKRLRSLEARFEGVKVIIGVDRLDYIKGIPQKLQALETFLTQHPEWIGKVVLVQLAIPSRQDVEEYQDLRACVNELVGRINGRFGTVESVPIHYMHKSVPFEELTAMYALADACLVTSTRDGMNLVAYEYISSQAEKHGSMILSEFAGAAQSFNGSLLINPWDVQSTADAIYQALTLSPQQRKSNWQKLFNYVSKYTAEAWGVSFVNELNRLSGQRPSGPAGLAGRRKSGSLSRRSSKASIQRRKSSQSGGIVTGLGAAAGAAVNWAQSQVQGGSQA

SEQ ID NO: 558 - protein, 495 aa, Saccharomyces cerevisiae
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFDTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 559 - protein, 989 aa, Cryptococcus bacillisporus
MDSMHPDPTPSIPPSLPELKAQVARLEASHKEKGLPLSGRIIHVMHHLPVEIVRIVPADSLESAGTGFLSPPMTPEFKPEDAETTVESADAKWRIHARTAHPALVSGIKSLSETHDQLLVAWTGEVLIQPDNTQSPQVPSQPTFSSIASNLLAPFSGTPGDSTPRLQPPPQQGTLKVFGGEFNEADQKEIASELDRFAEAEAKFDPTDKLKYVPVFLPPDVSKGHYEGFCKKTLWPLFHYLLWLDSTATVPSPDPSWLAYHKTNQMFAQRVAQIYKPGDLIICHDYHLLLAPKMIREALGQVFHPNAGWGTAHPSPSLHHAQGKGFEWESNQQTPTPEKAKGEKIGAFMNHVGTALGNHLGVMEHGQQNEIMIGMFMHTPWPSSEIFRCLPKRREILDGMLGANLVSFQTYSYSRHFVSTCIRVCGYESTPGGVDANGQVTAVGYCPIGIDIKRVVHDRDQPGVLPKAQALRDLYKDKKIIVGREKLDVAKGVYNKLQAFEKFLQVYPQWRGKVVLIQVTTPALSESPKLERMTAELVSHINGTYGSLDFTPVHHYHQALEKDEYFGLLSCADLALITSLRDGMNTTSMEFILCQDKTSKSPLVLSEFMGTAPSFASALQINPHDLLGVAQAINKGLTMRPEEKAERHAKLLEGVLAHTSHTWAATILKQLLENVGGEHTAHHTPVLDTALFADAYKKANKRLLLFDYDGTLTPIVKVPAHAVPTERTRSAITALCKDPKNVVYLISGRDGDFLEEHWGHLDRLGLSAEHGSFVKQPGEEEFINMTETLDMSWMSEVEEIFKYYTERTTGSTIEVKKASITWHYRNSDPDFGEFQCKQALDLLESSLAPRRPIEVLVGKKNLEVRPLAVNKGEIVRRLMYENPDVDMIFCAGDDKTDEDMFRALRTVFPPGGVVDDNPVVLKPPVAVTSAMEPEEADELPDVELSIRPKGVFATTVGPPAKKTLAGWHVTCPEEVVEALESLLEEIQVA

SEQ ID NO: 560 - protein, 543 aa, Arabidopsis thaliana
MRRFVIGQAKNLIDQSRRRQLHHHKNLSFVSLIPPFSAPSDSSSRHLSSSSSSDMSASDSSSSLPVTLDTINPKVIKCEYAVRGEIVNIAQKLQEDLKTNKDAYPFDEIIYCNIGNPQSLGQQPITFFREVLALCSYTALLDESATHGLFSSDSIERAWKILDQIPGRATGAYSHSQGIKGLRDAIADGIEARDGFPADPNDIFMTDGASPGVHMMMQLLITSEKDGILCPIPQYPLYSASIALHGGTLVPYYLDEASGWGLEISELKKQLEDARSKGITVRALAVINPGNPTGQVLSEENQRDVVKFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 561 - protein, 198 aa, Zea mays
TSDDLPLVSFQSVSKGYYGECGKRGGYMEITGFSPDVREQIYKVASVNLCSNVSGQILASLVMNPPKAGDESFESFMSERDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSRLKEFHEKFMDEFRD

SEQ ID NO: 562 - protein, 404 aa, Vibrio angustum S14
MQKFGMSSKLNNVCYDIRGPVLKHAKRMEEEGQKILKLNIGNPAPFGFDAPDEILVDVIRNLPTSQGYCDSKGIYSARKAVVQHYQKRGLLDLDVEDVYIGNGVSELIVMAMQALLNHKDEILVPSPDYPLWTAAVSLSGGTPVHYTCDEQSDWYPDLDDIKKKITPNTRGIVLINPNNPTGAVYSRDFLIEVVEIARQHDLIIFADEIYDKILYDGAQHTSIAPLAEDVVCVTFNGLSKSYRVCGFRAGWMIISGPRHRAKGYIEGLEMLSSMRLCANVPMQHAIQTALGGYQSINELILPGGRLLEQRNKAYDLLTQIPGVSCVKPKGALYLFPKLDQKKFNIQDDQKMAMDFLLQEKVLVVHGTGFNWKQPDHFRIVTLPHVDDLELAMGRLERFLHSYRQ

SEQ ID NO: 563 - protein, 174 aa, Pasteurella multocida subsp. multocida str. Pm70
MAVVGLFYGSDTGNTENIAKMIQKQLGSDLVDVRDIAKSTKEDIEAYDFLMIGIPTWYYGEAQCDWDDFFPTLEEIDFTDKLVAIFGCGDQEDYAEYFCDAMGTVRNIIEPKGAIIVGHWPTDGYHFEVSQALVDENTFVGLCIDEDRQPELTAERVEKWVKQVFDEMCLAELA

SEQ ID NO: 564 - protein, 532 aa, Oryza sativa
NQKLTSQVHEIVGRINGRFGTLTAVPIHHLDRSLDFHALCALYAVTDVALVTSLRDGMNLVSYEYVACQGSKKGVLILSEFAGAAQSLGAGAILVNPWNITEVADSIKHALTMSSDEREKRHRHNYAHVTTHTAQDWAETFVCELNETVAEAQLRTRQVPPDLPSQAAIQQYLHSKNRLLILGFNSTLTEPVESSGRRGGDQIKEMELKLHPELKGPLRALCEDEHTTVIVLSGSDRSVLDENFGEFNMWLAAEHGMFLRPTNGEWMTTMPEHLNMDWVDSVKNVFEYFTERTPRSHFEHRETSFVWNYKYADVEFGRLQARDMLQHLWTGPISNAAVDVVQGSRSVEVRSVGVTKGAAIDRILGEIVHSKSMITPIDYVLCIGHFLGKDEDIYVFFDPEYPSESKVKPDSSGSVSLDRRPNGRPSNGRSNSRNSQSRTPKAQAAPERSSSSSSSSQGTPNSHHDWREGSSVLDLKGENYFSCAVGRKRSNARYLLNSSEEVVSFLKEMADATAAHNGFQSTTADYMFLDRQ

SEQ ID NO: 565 - protein, 859 aa, Physcomitrella patens subsp. patens
MDNYEGSRNLNEKLHPSKQRLLVVANRLPVSAIRLEGDKWDLQLSAGGLVSALLGMHSFETRWIGWPGVSVHDEKGRASLTEALALKGCVPVFLDDDTVDQYYNGYCNNVLWPLFHYIGLPQADRLAATRSLDSQFQAYQHANSLFAKIVFSQYQEGDVVWCHDYHLMCLPQKLKELNPHMKVGWFLHTPFPSSEIYRTLPLRSELLKAVLTADLIGFHTYDYARHFVSACTRILGLEGTPEGVEDQGKLTRVAAFPIGIDPERFISALETEQVKLHVKELLRFFAGRKVMLGVDRLDMIKGIPQKLLAFEMFLEKNPQWREKVMLVQIAVPTRTDVHEYQRLTSQVHEIVGRINGRFGTVTFVPINHLDRSLAFHELCALYASTDVVLVTSLRDGMNLVSYEYVACQHMKNTEGVLVLSEFAGAAQSLGAGAILVNPWNIREMYKAIEEALTMSDEERKERHRHNFTHVMTHTAQAWAVNFLDCKDTNYTGSANASELNDTYVEAELRTLNEPPVLPVDTAKESFRRCTNRLLIFGFNSTITAAVEAPRRDQIKESKLGLHPGMKDSLKTLCSDPNTDVVILSGSRLDVLEEVFGEYGIWLAAENGMYLRDLSGNWMPTMEHLNMDWKEYVQRVFDYFCQRTPRSYVEKRETSLVWNYKYADVDFGKVQARNMLQHLWTGPISNAAVDVVQGQKSVEVRPIGVSKGAAIDRIVFEILRNKYPNGSYTSNIQFDFVMCVGHFLSKDEDVFAYFDPEIVLHRDYHGSIYSYSDRDLMGDLVNVSSDTYISCAVGKKRSSARYYLDTVNEVVSFVKSLADACPCELDSEDQSVLSVGSGSGPHVSPCSADSLPNGIPRHDL

SEQ ID NO: 566 - protein, 403 aa, Pseudomonas putida KT2440
MQFSKSNKLANVCYDIRGPVLKHAKRLEEEGHRILKLNIGNPAPFGFEAPDEILQDVIRNLPTAQGYSDSKGLFSARKAVMQYCQQKDIEGVTIEDIYLGNGVSELIVMSMQALLNNGDEVLIPAPDYPLWTAAVSLAGGKPVHYLCDEQADWFPDLEDIKAKITPNTKALVIINPNNPTGAVYSKELLLGMLELARQHNLVVFSDEIYDKILYDEAVHISTASLAPDLLCLTFNGLSKSYRVAGFRSGWLIISGPKHHAHSYIEGIDMLANMRLCANVPAQHAIQTALGGYQSINDLVLPPGRLLEQRNRTYELLNDIPGVSCVKPMGALYAFPRIDPKVCPILNDEKFALDLLLSEKLLIVQGTAFNWPWPDHFRVVTLPRVDDLEAAIGRIGNFLKGYSQ

SEQ ID NO: 567 - protein, 437 aa, Corynebacterium efficiens YS-314
MTTKKRNTSETTDTAPKAVGADQAARPVRRTTRRIFDQSEKMKDVLYEIRGPVAAEAERMELDGHNILKLNTGNPAVFGFDAPDVIMRDMIAALPTSQGYSTSKGIIPARRAVVTRYEVIPDFPNFDVDDVFLGNGVSELITMTMQALLNDGDEVLIPAPDYPLWTAATSLSGGKPVHYLCDEDNEWNPSIEDIRSKITEKTKAIVVINPNNPTGAVYSRKVLQEIADIAREYDLLVLADEIYDRILYDDAQHINMATLCPDLMCITYNGLSKAYRVAGYRAGWMIITGPKRYAKGFIDGLELLAGTRLCPNVPAQHGIQVALGGRQSIYGLTGEGGRLLNQRNVAWQKLNEIPGVSCYKPMGALYAFPRLDPNVYEIHDDTQLMLDILRSEKILLVQGTGFNWPHHDHFRVVTLPWASQLENAIERLGNFLVSYKQ

SEQ ID NO: 568 - protein, 463 aa, Lentinus tigrinus
AVGPVADLTVTNANISPDGFERAAIVVNNVFPAPLITGNMGDNFQLNLVNQMTNHTMLKTTSIHWHGFFQKGTNWADGPAFINQCPIASGNSFLYDFQVPGQAGTFWYHSHLSTQYCDGLRGPFVVYDPNDPHANLYDVDDESTVITLADWYHVAAKLGPRFPLGADSTLINGLGRSTSTPTADLAVISVTKGKRYRFRLVSLSCDPNYTFSIDSHQLTVIEADGVSTQPVTVDSIQIFAAQRYSFVLNANQDVDNYWIRANPNFGTTGFADGVNSAILRYDDADPVEPVTNQTGTTLLLETDLHPLTSMPVPGNPTQGGADLNLNMAFNFDGTNFFINGESFTPPTVPVLLQIISGANTAQDLLPSGSVYSLPSNSSIEITFPATTAAPGAPHPFHLHGHVFAVVRSAGSTSYNYDDPVWRDVVSTGTPQAGDNVTIRFQTDNPGPWFLHCHIDFHLEAGFA

SEQ ID NO: 569 - protein, 474 aa, Escherichia coli O157:H7 EDL933
MSRLVVVSNRIAPPDEHAASAGGLAVGILGALKAAGGLWFGWSGETGNEDQPLKKVKKGNITWASFNLSEQDLDEYYNQFSNAVLWPAFHYRLDLVQFQRPAWDGYLRVNALLADKLLPLLQDDDIIWIHDYHLLPFAHELRKRGVNNRIGFFLHIPFPTPEIFNALPTYDTLLEQLCDYDLLGFQTENDRLAFLDCLSNLTRVTTRSAKSHTAWGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLMKIFRYSDVGLVTPLRDGMNLVAKEYVAAQDPANPGVLVLSQFAGAANELTSALIVNPYDRDEVAVALDRALTMSLAERISRHAEMLDVIVKNDINHWQECFISDLKQIVPRSAESQQRDKVATFPKLV

SEQ ID NO: 570 - protein, 374 aa, Solanum melongena
LQEFDPDQMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATALCQPSFISISEVMNEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVGITTLKSNAGLFIWMDLRRFLENSTFDDELKLWHIIINKVKLNVSPGCSFHCSEPGWFRVCFAA

SEQ ID NO: 571 - protein, 548 aa, Coccidioides immitis RS
MPPLPRYTRSFALSFPPRERVLSGARLVPLTRFAAGSASPVLDIARSSSLGPWISSRSYSGNKMGSLPVGRLHKGNINPNVLAAKYAVRGELAVKAEEYRVKLEQELDTLPFDKVIFANIGNPQQLDQKPITFFRQVLSLMEYPPLLENEETLKSVFGYKQDVIDRAKYLLKDVQSVGAYSQSHGSPLVRKSVANFMEKRDGFPADPAHIYLSAGASSGVNTLLNILCAGHDSGVLVPIPQYPLYTATLAVLNARCVPYYLDEESNWGTDVDGIKASVAKAKEEGTDVRAIVVINPGNPTGACLSPEAVKKVIDLAVDEHLVIIADEVYQTNIFKGEFTSFKKRLRQLQQESPGKYDHVELASLHSVSKGMVGECGHRGGYFELVGFHADVEEQVYKFISVMLCPPVIGQCLVELMVNPPREGDPSYELYQKEYSAISTGLYQRAAALYEAFKQMEGVECQEPTGAMYLFPSITLPQKAIAAAEAAGRHPDEFYSLRLLDATGVCIVPGSGFGQKPGTYHFRTTFLAPGTDWVNRIVAFHKKFMDEFR

SEQ ID NO: 572 - protein, 497 aa, Streptomyces hygroscopicus subsp. limoneus
MTGSEIFLASKRAAITYDTDPATGEPRAWLAPGGTGNVVAEQAGVLNISWIASADSEDDRRASALNPDGVTMELHSGREILVRLIRHDPAVFRNVQNFMTANLMWAANNYGWDRWTQPSFGSDAREGWADFGRFTRDFADAILKSSAQSADPVYLVHDYQLVGVPALLREQRPDAPILLFVHIPWPSADYWRILPKEIRTGILHGMLPATTIGFFADRWCRNFLESVADLLPDARIDREAMTVEWRGHRTRLRTMPLGYSPLTLDGRNPQLPEGIEEWADGHRLVVHSGRTDPIKNAERAVRAFVLAARGGGLEKTRMLVRMNPNRLYVPANADYVHRVETAVAEANAELGSDTVRIDNDNDVNHTIACFRRADLLIFNSTVDGQNLSTFEAPLVNERDADVILSETCGAAEVLGEYCRSVNPFDLVEQAEAISAALAAGPRQRAEAAARRRDAARPWTLEAWVQAQLDGLAADHAARTATAERFDTAPAVSTRADL

SEQ ID NO: 573 - protein, 437 aa, Corynebacterium glutamicum ATCC 13032
MTTDKRKTSKTTDTANKAVGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 574 - protein, 517 aa, Coprinopsis cinerea okayama7#130
MLLLATALATSLLPFVLGAIGPSTNLVVANKVIAPDGFSRSAVLAGATQPTVQFPGPVIQGNKNSFFAINVIDALTDPTMLRTTSIHWHGMFQRGTAWADGPAGVTQCPISPGHSFLYKFQALNQAGTFWYHSHHESQYCDGLRGAMVVYDPVDPHRNLYDIDNEATIITLADWYHVPAPSAGLVPTPDSTLINGKGRYAGGPTVPLAVISVTRNRRYRFRLVSLSCDPNYVFSIDGHTMTVIEVDGVNVQPLVVDSIQIFAGQRYSFVLNANRPVGNYWVRANPNIGTTGFVGGVNSAILRYVGASNTDPTTTQTPFSNPLLETNLHPLTNPAAPGLPTPGGVDVAINLNTVFDFSSLTFSVNGATFHQPPVPVLLQIMSGAQTAQQLLPSGSVYVLPRNKVIELSMPGGSTGSPHPFHLHGHEFAVVRSAGSSTYNFANPVRRDVVSAGVAGDNVTIRFRTDNPGPWILHCHIDWHLVLGLAVVFAEDAPTVATMDPPPAWDQLCPIYDALPPNT

SEQ ID NO: 575 - protein, 838 aa, Ostreococcus tauri
MRYRARVRCAALVASEVDVGGRSSGDLSAQSGASETRGDRVFVVSNTLPLKMREDAAAGKMYGHAYAFEADEESIYDQCREGALKGGQFEVVINVGQLPMEVPMEMQDAVANDLERRYNCMPVFLPKEVKENFYNGFCKQYMWPLMHYVLPMSPMDARFETHQWQAYIASNKRFADKLMETVSSDDDLVWVNDYHLMLLPTFLRKRFNAVKCGFFLHCPFPSSEIFRTTPTRDLILRGLLNADFVGFHTFDYARHFLSCCTRLLGLNHRMERGSLVIDNHGRLVSVKICPTGVKISRLQQVLDTDVCRNRRQELLKEVAGRKILLGVDDFDEFKGIDLRMTAFERMLEEHPRLAEQVCLMQTCTPPRSSGRDINELRNTVNELVERINAKYSVNGVPVLKFEIKPVAIHERIALHSVADVSVVTATRDGMNLAPYEYITCRQGPSDEARGTAEGFSLPRQSALIISEFTGCSPSLSGALRVNPWHIQDVADAMYKALQMSGHEHEARHEKHWRYVSEHHVGFWAQSCLAELQRVTEKANGNRCYGLGFGLNFRVVHLSSQFRKLDTPTVVADYLKAKRRKLVIDYDGTLVPLVSYAQPPSAHLLSLLTVLTSDQANEVCIVSGRERGTLDKWFGNIPRLWMVAEHGYWFRKGSDVAWKELAPIGTDTSVHEWKETVLPILEQYSEATDGSFIQTKESAYVWHYRDADPDFGAWQAKELLDHLDSVLHGDGVDVISGNGTVEIKPKGVHKGLVIDELLNVDEAASNVADFVLAVGDDKSDEDMFSAVATHTALPLYAGSSVYTSTIGQKPSKAPAYLDDTDDVVNLLQTLAQYNVCHRH

SEQ ID NO: 576 - protein, 411 aa, Cupriavidus taiwanensis
MKPIQKSNKLNNVCYDIRGPVLEKAKQMEEEGHKIIKLNIGNLAVFGFDAPEEIQQDMMRNLPNSAGYSDSKGIFAARKAIMHYTQQKNIEGVGLDDIYVGNGASELIVMAVNALLNTGDEVLVPAPDYPLWTAAVSLSGGTPVHYICDEANEWMPDPADIRARITPHTKAIVIINPNNPTGALYSDELLLEIVAIAREHGLIIFADEIYDKVLYDGNTHTSIASLSTDVLTVTFNGLSKNYRSCGYRAGWMVVSGDKRPAIDYIEGLNMLSSMRLCANVPGQWAIQTALGGYQSINDLVAEGGRLRRQRDLAYELITAIPGVTCVKPKAALYLFPKLDLSMYPVQDDQEFIYELLQESKVLLVQGSGFNWARPDHFRIVFLPHEEDLREAIGRIARFLEAYRKRHGKAAA

SEQ ID NO: 577 - protein, 496 aa, Coprinopsis cinerea okayama7#130
MSRKLFSLAYLAVVLVSVAGQILGPTSTMTVSNIDASPDGFNRPVVAVNGQHPGPLVRANKGDNFRINVVNDLNDPTMLRQTSVVRQTSGLQRRLECFMVTALQNSIGTECSSTAQPGQMAPTESLSARSLRTESRLSTGSMLEMKLAHSGTTLISAPSIEGPALSDATLINGKGRRPGGPETDIAIVNVQRNRRYRFRLVSMSCDPNYKFSIDGHKLTVIEADGQLTEPLMVDEIQIFAGQRYSFVLSANRPVGNYWIRAIPNVGSNNLPNFSSGGINSAILRYAGAPNANPTSTPVTNPVALHESNLHALLNPGAPGGSGPADENIVLQMGLGPAGFEINGVTWANPDSPVMVQIMNGVPPADIVPSGAIHTLPRNRVVEVSIPGFELAGPHAFSVVRSAGSSTYNYENPVRRDVVDVGGASDNVTIRFTTDNPGPWFFHCLLPFGYSGLAMVFMEAPSDIPSTSPPPPSWSELCPKFESLPASATSIQIVPTP

SEQ ID NO: 578 - protein, 530 aa, Coprinopsis cinerea okayama7#130
MFSFISSKLALLVQLALASTTFAAHVNYTFNIVNANLAPDGFTRPTVVVNGQFPGTLIQANKDDILHITVNNQLTNPLMRRSTAIHWHGLFQRQTASEDGPAGVTQCPISPGHSYTYDIPLNGQAGTHWYHSHLSSQYVDGLRGAIVIYDPDDPHKSLYDEDDANTIIQLGDWYHKPAPGIQAAYLADRTDEPVPDCGTINGVGRYVRGPRLPWSRINVVRGKRYRLRVINISAYGSFEFSIENHPVTIIEVDGINHVPKTVGGFEIFAGQRYSVVLNANQPVRNYWIRAPMDVKGDSDNDNLDDELIYAVLHYDGAPNADPTTRADRDADNMLREHELVPLDNPGVPGGTGPADRVIDLQYSRSTSGGTKWTFNGIQYHSPNTNTLLKVMAGATIASDFTPSEHTIILNHNETVELRLHGSSNGHVHPFHLHGHAFSVIKGESGPENYVNPPRRDVFGIKSGTGIIRFRTDNPGPWFLHCHIDWHLEAGLAVVFAEAPDQIRDGPQAQVIKQEWLDLCPIYNALPPELQ

SEQ ID NO: 579 - protein, 531 aa, Lentinus sajor-caju
MFPGARILATLTLALHLLHGAHAAIGPVGDMYIINEDVSPDGFTRSAVVARSAPSTESTSETGSTPGVLVQGNKGDNFQLNVLNQLSDTTMLKTTSIHWHGIFQTNSTWADGPAFVNQCPIASGNSFLYDFNVADQAGTFWYHSHLSTQYCDGLRGPLVIYDPSDPHLSLYDIDNADTVITLEDWYHVVAPQNAVLPTADSTLINGKGRFAGGDTTALAVINVESNKRYRFRLVSMSCDPNFTFSIDGHSLQVIEADAVNIVPIVVDSIQIFAGQRYSFVLNANQTVDNYWIRANPNLGSTGFDGGINSAILRYAGATEDDPTTTSATSTPLEETNLVPLENPGAPGPAVPGGADININLAMAFDFTNFELTINGSPFQAPTAPVLLQILSGATDAASLLPSGSIYAPEANKVVEISIPALAVGGPHPLHLHGHTFDVIRSAGSTTYNFDTPARRDVVNTGTDANDNVTIRFTTDNPGPWFLHCHIDWHLEIGLAVVFAEDVTSIAAPPAAWDDLCPIYDALSDTDKGGIA

SEQ ID NO: 580 - protein, 176 aa, Pectobacterium atrosepticum SCRI1043
MANIGIFFGTDTGKTRKIAKMIHQKLGDTADSPVNINRTSLDSFLSYSVLLLGTPTLGEGQLPGMNAGCENESWQEFIAELPDEALADKTVALFGLGDQQGYPDNFVSGMKTLYDVVTACGAKVIGAWPNAGYDFNTSAALVDDQFVGLVLDQDNQYDLTDERLDSWLETLKPAIG

SEQ ID NO: 581 - protein, 532 aa, Lentinus sajor-caju
MRALSHFIASLTLVLWFRPGANAVETIGPVGSMRIVNKVVSPDGFSRSAVVAGKTAAGATNPGVLVHGWKGNNFKLNVINELTDTTMLKTTSIHWHGFFQAGTSWADGPAFVTQCPIAAGNSFLYDFEVPDQAGTFWYHSHLSTQYCDGLRGAFVVYDLFDPPRLRYDIDNADTVITLEDWYHVVAPQNGPIPTPDSTLINGLGRYAGGPTSPLAVVRVLWGLRYRFRLVSLSCDPNWTFSIDGHKLLVIEADAVNVEPVEVDSIQIFAGQRYSFVLRANQQIANYWIRAEPNLGTVGFAGGINSAILRYILAPNADPTTTAPASPVQLAETDLVPLSNPGAPGPPVPGGADVNINLAMNFDFTNFELIINGQAFHPPTAPVLLQILSGATTAASLLPAGSIYELPPNKVIELSIPALAIGGPHPFHLHGHTFDVIRSAGMTTYNFDTPARRDVVNTGVGAEDNVTIRFVTDNPGPWFLHCHIDWHLEIGLAIVFAEDAPIVNTENPPSSWDDLCPIYDALTEEEKGGLLPT

SEQ ID NO: 582 - protein, 426 aa, Thiobacillus denitrificans ATCC 25259
MFCLEFTHWEIAVTADKKPRLRTIQKSTKLDNVCYDIRGPVMARARQMEEEGQRIIKLNIGNPAPFGFEAPEEIVQDVILNLPNASGYSDSKGLFAARKAIMHETQRKGIAGVTIDDIIVGNGVSELIVMAMQALLNNGDEVLVPAPDYPLWTAAVSLGGGKPRHYLCDEGAGWLPDLDDIRAKITPSTRAIVIINPNNPTGALYPTELLREILEIARQHQLIVYADEIYDKVLFDGVVHTSIASLADDLLIVTFNGLSKNYRACGYRSGWLVVSGDKRHAKDYLEGLNMLASMRLCSNVPGQHAIQTALGGYQSINDLVAPSGRLTRQRDLAHELLTLIPGVSCVKPKAAMYLFPRLDPKLYPIHDDQKFILNLLEEERVLVVQGTGFNWPRPDHLRVVFLPHEEDLTEAIGRMSRFLDRQRAHR

SEQ ID NO: 583 - protein, 520 aa, Candida albicans SC5314
MLRVNSRLLTTRKSQFMFTSNSLRFLATFKPADPLTTHDINPQTVEAKYAVRGKIPIIADELNELIQKQPQSHGLPFSKIINANIGNPQQLEQRPLTWYRQVLSLLQYPDLLKNGDPETVKSLYPEDVIERAQSILKHIGSIGAYSHSQGASYFRQSIAEFITNRDGGYVSHANNIFLTSGASTAVSYLLQILSVNENSGFLIPIPQYPLYTATIALNNAKPIGYYLDESNHWSTNPQEIRELIETNQSQGINIKALVVINPGNPTGAILSSQDIIELIDIAAEYGIVLIADEVYQENIFKGKFVSFKKILSELIEQDPQTYKHVQLASLHSTSKGVSGECGQRGGYMELVGFKPEVKDVVFKLASINLCSVVSGQALMELMINPPQEGDPSYPLYKSETESIHNDLESRAESLYQAFLQMEDIKCNKPMGAMYIFPTLDFDPARYHKLYSRAKNSNLQIDDIYCIELLEGTGICCVPGNGFGQKPDTYHLRTTFLPPGKEWIDKWINFHKSFIKKYKDE

SEQ ID NO: 584 - protein, 460 aa, Rhodospirillum rubrum ATCC 11170
MARLIVVSNRVALPEDQAGRAGGLAVALREALVSFGGIWFGWSGKVAAQTSDRPRFIEEGPVTYAVLDLGRKDHAQYYNGFANRTLWPLFHYRMGLAEFTRQDYEGYMRVNTVFAEQLQPLLTDDDLIWVHDYHLIPLGGELRRLGARQRMGIFLHTPFPAMEVLLALTHHRRLVGSLCAYDVVGFQTENDRRSFFDYVLHEAGGWIGENGHVTVWGRSLVARVYPIGIEKGAFAEAAQRAQRTVAYRRLRASLNGRKLMIGVERLDYSKGLPERFEAFSRLLEKHPEHRAKVSFMQVAPISRSEVPEYRRLREELESLSGQINGQFGDYDWVPIRYLTRNFARSVLAGFYRQGAVGVVTPMRDGMNLVAKEYVASQNPQDPGVLVLSRFAGAARELTTALQVNPFDREDMADAMDRALGMALDERKERWVEMMRMVDENSLEAWREKYLADLNAAPFNG

SEQ ID NO: 585 - protein, 521 aa, Lentinus sajor-caju
MVLSTKLVALVASLPFVFAVTKKLDFHIRNDVVSPDGFERRAITVNGIFPGTPVILQKNDKVQIKTINELTDPGMRRSTSIHWHGLFQHKTSGMDGPSFVNQCPIPPNTTFLYDFDTAGQTGNYWYHSHLSTQYCDGLRGSFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVNANQTIDNYWIRAPLTGGNPAGNPNLDVSLIRAILRYKGAPAVEPTSVATTEGHKLNDADMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRVSNSDVVNLVNPPRRDVLPINGGNTTFRFFSGNSGAWFLHCHIDWHLEAGLAVVFAERPAEVNEGEQAQIVTQDWRTLCPAYDGLAPEFQ

SEQ ID NO: 586 - protein, 274 aa, Oryza sativa
  misc_feature (221)..(221): Xaa can be any naturally occurring amino acid
MAMAAAPRPKSPPAPPDPCGRHRLQLAVDALHREIGFLEGEINSIEGIHAASRCCREVDEFIGRTPDPFITISSEKRSHDHSHHFLKKFRCLCRASACCLSYLSWICCCSSAAGGCSSSSSSSFNLKRPSCCCNCNCNCCSSSSSSCGAALTKSPCRCRRRSCCCRRCCCGGVGVRACASCSCSPPCACCAPPCAGCSCRCTCPCPCPGGCSCAGPGGGRXCCGRPPLCWPPPGFGDPNQPNWTQTCPRIWVKLNLVPRKEETESGPAAPAILK

SEQ ID NO: 587 - protein, 532 aa, Lentinus sajor-caju
MFPGARILATLALALHLLHGALAAIGPVGDMYIVNEDVSPDGFSRSAVVARSVPITGPTPATASIPGVLVQGNKGDNFQLNVVNQLSDTTMLKTTSIHWHGFFQAGSSWADGPAFVTQCPVAPGDSFLYNFNVPDQAGTFWYHSHLSTQYCDGLRGPFVVYDPTDPHLSLYDIDNADTVITLEDWYHIVAPQNAAIPTPDSTLINGKGRYAGGPTSPLAVINVESTKRYRFRLVSMSCDPNFTFSIDGHSLLVIEADAVNIVPITVDSIQIFAGQRYSFVLTADQTPDNYWIRANPNLGSTGFAGGINSAILRYVGAADADPTTTSSTSTPLLETNLVPLENPGAPGPAVPGGADININLAMAFDFTTFELTINGVPFHPPTAPVLLQILSGASSAASLLPSGSIYELAPNKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDALCPIYDALSDADKGGIIP

SEQ ID NO: 588 - protein, 514 aa, Pholiota nameko
MLSLPILVYLSTITSAYAAIGPTANVHIANKIISPDGFNRSAVLAGTNASSIAFPGPVITGFKGDTFQLNVIDALTNTTMLRSTSIHWHGFFQRGSSWADGPVGVTQCPISPGNSFVYQFSSADQAGTFWYHSHHSTQYCDGLRGAMVVYDRQDPHRNRYEFDDESTIITLADWYHVVAPSAGLVPTPDATLINGIGRYAGGPTVPLAVIRVLPNRRYRFRLVSISCDPNYTFSIDGHNMTIIEVETVNTTPLEVDLIQIFAGQRYSFVLNTNQPVSNYWIRAEPNVGTQGFAGGINSAILRYWGAPTIDPNTTSALSNPLRETNLVPLSGAAAPGTPQVGAADVNLNLDILFNATNNRFTVNNATFAPPTVPVLLQIMNGTRTAAELLPRGSVYVLPPNRVVELSLPGGSVGSPHPIHLHGHTFDVVRSVGSSAYNYANPIKRDVVSIGGAGDNVTIRFRTDNPGPWIMHCHIDWHFEIGLSVVFAEDVDTVNVSTPAAWSQLCPNYNATNAP

SEQ ID NO: 589 - protein, 525 aa, Lentinus sajor-caju
MAPLVRALACLAILAVTNVYGATVGNNADIYIANKVIAPDGFERSGVLAGTAAGVEVIGPLVRGWKGNRFRLNVINQLSDSSMLKTTSIHWHGFFQEGSSWADGPAFVTQCPIASGDSFLYDFRVPDQAGTFWYHAHLSTQYCDGLRGAFVVYDLLDPHRLRYLVDNEDTVITLADWYHTVAPQAGLVPVPDSTLINGRGRYAGGPTVPLSLIRVLWGVKYRFRLVSLSCDPNYTFSIDGHKMTIIEVDGVNTKPLEVDSIQIFAGQRYSFVLHANQRIANYWIRANPNLGTRGFEGGLNSAILRYYGAPNRDPTTTQETSVNPLVETNLVPLRDAGAPGVPGVGNADVNINLAMAFDFPSLQFTINGAPWVSPTSPVLLQIISGASSASELLPPGSIYTLPRNKVVELSIPALAIGGPHPIHLHGHAFDVVRSAGSSTYNYNNPVRRDVVSTGTGSDNVTIRFKTDNPGPWFLHCHIDWHLEIGLAVVFAEDTASTSKQRPPKSWSDLCPIYDSLTEEQKGGIV

SEQ ID NO: 590 - protein, 213 aa, Brassica napus
  misc_feature (169)..(169): Xaa can be any naturally occurring amino acid
  misc_feature (181)..(181): Xaa can be any naturally occurring amino acid
KNTEPYSLAVESLHKQTHTQRDMVSRSYSNLLDLASGNFHSFSREKKRFPRVATVTGVLSELDDDTNSNSVCSDAPSSVAQDRIIIVGNQLPIKSHRTSSGKLTFTWDNDSLLLQLKDGMREDMEVVYIGCLKDQVDPSEQDDVAQRLLENFKCVPAYIPPEIFTKYYXHGLLQKQHLWPXLFHYMLPLNPDLGGRFDRSLWQAYLSVNKIFA

SEQ ID NO: 591 - protein, 295 aa, Hordeum vulgare
MGEGAVVVLEPPKPRSPPRYPDMCGRRRLQLEVQILDRELTFLKDELHLLEGAQPVSRSACLKEVNEFVGTKQDPLIPINKRKHRSCRLYWWIRSKLCVCASWLCCSCQCLPTCKRPSCLDCSCCEPNCSCCSPNCCSCFKIPSCCKPSCGCFGCCSCSKPQCCSGGCNPCGECKPECGSCSAGGCCGDCKPSCSCCGEQCQCCSCPRCTGGCFKLPKCSCAQCFNCQSSCCKGQPSCFRCQSSCCDKGGCCSSGSCLSCPKPSCPECSCGCVWSCKNCTDGCRCARCCASGCLC

SEQ ID NO: 592 - protein, 249 aa, Zea mays; identical to SEQ ID NO: 29

SEQ ID NO: 593 - protein, 483 aa, Kineococcus radiotolerans SRS30216
MAGDYDLVVVANRLPVDRVEEPDGSTSWRRSPGGLVTALEPVMQREDGAWVGWAGTPGDPPEPFDAEGVRCVPVGLSEQEVEDYYEGFSNGTLWPLYHDVIVAPGYHRSWWEAYVRVNERFAEAAAEQATEGATVWVQDYQLQLVPRMLRRRRPDLSIGFFNHIPFPPFEIFAQLPWRKAVIDGLLGADLIGFQRAADANNFTRACRRASNLPARSGRIRLDAEGGREVRAASFPISIDFAALDELAEREDVKARAAEIRRDLGNPEHVLLGVDRLDYTKGILHRLKAFEELLDDGGVKVEEASLIQVATPSRERVEQYVQLRQDVEVTVGRINGTHGTIKNTAVHYLHHSYGREEMAALFLAADVMLVTALRDGMNLVAKEYVASRHDERGVLVLSEFTGAADELGQALMINPHDIDGLKDAILRALRMSPREAGRRMRSLRRRVGDHDVQRWAASFLQALADHHTTEAAVSVAAAAERGSS

SEQ ID NO: 594 - protein, 122 aa, Zea mays
  misc_feature (113)..(113): Xaa can be any naturally occurring amino acid
  misc_feature (116)..(121): Xaa can be any naturally occurring amino acid
MALKALDYDTLNENVKKCQYAVRGELYLRASELQKEGKKIIFTNVGNPHALGQKPLTFPRQVVALCQAPFLLDDPNVGMLFPADAIARAKHYLSLTSGRFCALCGACGRPGVXKEXXXXXXR

SEQ ID NO: 595 - protein, 559 aa, Melanocarpus albomyces
EPTCNTPSNRACWSDGFDINTDYEVSTPDTGVTQSYVFNLTEVDNWMGPDGVVKEKVMLINGNIMGPNIVANWGDTVEVTVINNLVTNGTSIHWHGIHQKDTNLHDGANGVTECPIPPKGGQRTYRWRARQYGTSWYHSHFSAQYGNGVVGTIQINGPASLPYDIDLGVFPITDYYYRAADDLVHFTQNNAPPFSDNVLINGTAVNPNTGEGQYANVTLTPGKRHRLRILNTSTENHFQVSLVNHTMTVIAADMVPVNAMTVDSLFLAVGQRYDVVIDASRAPDNYWFNVTFGGQAACGGSLNPHPAAIFHYAGAPGGLPTDEGTPPVDHQCLDTLDVRPVVPRSVPVNSFVKRPDNTLPVALDLTGTPLFVWKVNGSDINVDWGKPIIDYILTGNTSYPVSDNIVQVDAVDQWTYWLIENDPEGPFSLPHPMHLHGHDFLVLGRSPDVPAASQQRFVFDPAVDLARLNGDNPPRRDTTMLPAGGWLLLAFRTDNPGAWLFHCHIAWHVSGGLSVDFLERPADLRQRISQEDEDDFNRVCDEWRAYWPTNPYPKIDSGL

SEQ ID NO: 596 - protein, 710 aa, Ustilago maydis 521
MRLSLVSLALLGLAANHALAFPASLGDVKRNTDHAPYFDTDKSALDPDLTLGPDMLGSDDVDEFVRRIDQVLQSYEPDLSSFGLGPVPGFWPGHRHGDAHNHGPPHAHEDGHKDQGHQVPGSRPINGKPPKDTCKPKPPSGVSHKCEKRDFTPQTREFDWTITYGHSAPDGFLKKRILVNGQSPGPLIEANEGDTIVVKVRNLLDQGTSIHWHGMFQNSTPFMDGIAGFSQCPIPPRGHLTYRFKIEGQYGSYWWHSHSKMQYTDGLYGGLIVHSKRDPYQKCRDYDDERVFLFADNYHDFADYIVQQLLSANGYNGTAAAPSPQSGLINGAGQFNCAALAHAKGKQPGMPTRCTQLPTPTMDVEPNKKYRFRFINTGSHAQHIISIDNHELEVIAADGTPVKPHKVHRVPIHNGQRHDVFVDTNQGSDGDSFLLRSAMMTACFSFVDPLLDPVANLTLQYRLPGSKIAPKRPVPHDWKDAMGSQCQDLKDSELVPAIDTSVPPNHNLGSLGIFNSQFGNLQLANGTTLGRFFVDNVTQTNYVNKPYLEVTHAGGQINSSTVASLLIPDDVWVADIVINNEDSFLDHPFHLHATDMHIVARGSGSMTQAQWIALNQNAQPQNGNASALNLKNPLRRDTITVPRSSFVVVRIIPDLPGVWAMHCHIAMHVAEGLMAAIAIHPHKIRELKFSQEVLDLCLVSRAALNEVEPA

SEQ ID NO: 597 - protein, 234 aa, Xenorhabdus nematophila
MFSINKSSKLDNVCYDIRGNTLKEAKRLEEEGNKVLKLNIGNPAPFGFEAPDEILVDVIRNLSTAQGYSDSKGLYSARKAIMQHYQARNMLDITVEDIFIGNGVSELIVQSMQALLNTGDEMLVPAPDYPLWTAAVSLSSGNAVHYRCDEQQGWFPDLDDIRRKITPRTRGIVIINPNNPTGAVYSKELLLGIVEIARQYNLIIFADEIYDKILYDDAQHHSIAALAPDLFTVT

SEQ ID NO: 598 - protein, 554 aa, Oryza sativa
MASAAMLVPLVLVLCTAAASAAVVEHTFKVGGTKITQLCMNSVIYTANQQLPGPTIEVTEGDTLVVHAVNDSPYPLSLHWHGVYQLRSGWNDGANKITQCPIQPSGNFTYRFNITGQEGTLWWHAHSSLLRATIYGALIIKPRNGPSGYPFPEPYEEIPILLGEWWNRNVDDVENDGYLTGLGPQISDALTINGMPGDQNRCKGSAMYEVEVEYGKTCLLRIINAAVNVELFFKVAGHTFTVVAADASYTKPYATDVIVIAPGQTVDALMNTTASPGRYYMAAHVFDSKTVAVPFDQSTATGIVKYKGVPNYAPAAMPSLPPHDDVVTAGRFYWSLTGLARPSDPGVPTTVDHNMVVTFGLDQAPCAPNQTKCSGFALVAAMNRNSFQFPDQKVSLLEALYKGVPGVYSEDFPDFPPPMQGFRKATAVKKVKYNDVVEVVLQSEQYSSTLGTENHPIHLHGFDFYLLAQGLGRFNLSMKSKYNLVDPQVRNTVAVPAGGWAVIRFMANNPGMWFMHCHLDAHLPLGLAMVFEVLNGPAPNLLPPPPVDHPKCHG

SEQ ID NO: 599 - protein, 574 aa, Candida glabrata CBS 138
MLRSTTSKSLSKMPHAIPPQCRRSHSSSIFQTKKRLAHLESDRPYLTHLPRSMNSSPNLRFHSSASSSSLRSSFLNTEIHHHSHNNLPFLPAEQATLKDVNECVLNAKYAVRGAIPMRAEELKTQLMENPHSLPFNDIINANIGNPQQLKQKPLSFYRQVLSLLQYPELIPTLENNPQTMIKQDAIDRAKRLLDDIGGSVGAYSSSQGVLGIRKTVADFITNRDDGIIAYPEDIFLTAGASSAVDYLLSIFCRGEETGVLIPIPQYPLYTATLALQNSHALPYYLNEETGWSTDPEELESIILDSIENNIKPSVLVVINPGNPTGAVLSEEAIEQIFTLAAKYGIIVIADEVYQENVFEDVKFHSMKKVLRQLQMKQPGLYDNVQLASLHSTSKGVSGECGQRGGYMELVGFTHDIRQVVLKLASISLCPVVTGQALVDLMVCPPQKGEESYEQDQEERRNIHKELHKRATLLHDAFVKLDGISCQKPQGAMYLFPKLELPYKAIQEALHQDMSPDEFYCKSLLEKTGICTVPGSGFGQEPGTYHLRTTFLAPGTKWIEDWVDFHQEFYNKFKN

SEQ ID NO: 600 - protein, 465 aa, Lentinus sajor-caju
MFPGARILATLTLALHLLHGTHAAIGPAGNMYIVNEDVSPDSFARSAVVARSVPATDPTPATASIPGVLVQGNKGDNFQLNVVNQLSDTTMLRTTSIHWHGFFQAGSSWADGPAFVTQCPVASGDSFLYNFNVPDQAGTFWYHSHLSTQYCDGLRGPFVVYDPSDPHLSLYDIDNADTVITLEDWYHIVAPQNAAIPTPDSTLINGKGRYAGGPTSPLAIINVESNKRYRFRLVSMSCDPNFTFSIDGHSLLVIEADAVNIVPITVDSIQIFAGQRYSFVLTANQAVDKYWIRANPNLGSTGFVGGINSAILRYAGATEDDPTTTSSTSTPLLETNLVPLENPGAPGPPVPGGADININLAMAFDFTTFELTINGVPFLPPTAPVLLQILSGASTAASLLPSGSIYELEANKVVEISMPALAVGGPHPFHLHGHTFDVIRSAGSTTYNFDTPARRDVVNTGTGAN

SEQ ID NO: 601 - protein, 458 aa, Zea mays
MSYNKAPSITAETINPRVKIIRYAPCGEIVKHAARLEQEIEENPASIPFQEIIYCNLGNPQVLGQPPLTFFREVLSLCDNPALMDRDEARALFSPCSIRRARRILNSIPSKDTGGYTDCRGIKCLRQVVADGITARDGFPSTADDIFLTDGATSAVPYNLTEDNGWGLEIFEVKRCLEEARSAGLTVRAMVVINPGNPTGQVLSVTNQEEIVEFCRKEGLVILADEVYQENIYAENKKFHSFKKVARSLAYDENDLTLVSLHSVSMSYGESGRRGGYMEVSGVAANVKDQIYKVASLTLCPNIAGQILVSLAMDPPKLGDESFESFDKEKEQIRSSFCKRAKTLEKAFSGLEGVTCNKLEGALYLFPRLHLPSAAIRAADFEGVSPDIFYAHRLLDATGIAVVPGSGFHQASGTIHIRCTILPDERKIEAMVARLRAFHKAFMNEFRGSQQVMNDLRR

SEQ ID NO: 602 - protein, 942 aa, Arabidopsis thaliana
MPGNKYNCSSSHIPLSRTERLLRDRELREKRKSNRARNPNDVAGSSENSENDLRLEGDSSRQYVEQYLEGAAAAMAHDDACERQEVRPYNRQRLLVVANRLPVSPVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVKQHMKELKERFTDRKVMLGVDRLDMIKGIPQKILAFEKFLEENANWRDKVVLLKIAVPTRPDVPEYQTLTSQVHEIVGRIIGRLGTLTAVPIHHLDRSLDFHALCALYAVTDVALVTSLRDGMNLVSYEFVACQEAKKGVLILSEFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSP

SEQ ID NO: 603 - protein, 913 aa, Oryza sativa Japonica Group
MMSRSYTNLLDLAEGNFAALGPGGGGGGRRRSGSFGLKRMSRVMTVPGTLSELDGEDDSEHAATNSVASDVPSSVAGDRVIVVSNQLPVVARRRPDGRGWSFSWDDDSLLLQLRDGIPDEMEVFFVGSLRAEIPVADQEEVSQALLDRFRCAPVFLPDPLNERFYHRFCKRHLWPLFHYMLPFSSSASPSPSSSSSSSSSPSSSSGSGHFDRGAWEAYVLANKFFFEKVVEVINPEDDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGVHMGQLKTVLSLPDREWRVSELQQQFEGKTVLLGVDDMDIFKGINLKLLAFENMLRTHPKWQGRAVLVQIANPARGKGKDLEAIQAEIHESCKRINGEFGQSGYSPVVFIDRDVSSVEKIAYYTIAECVVVTAVRDGMNLTPYEYIVCRQGSDSTSEVNGPKKSMLVVSEFIGCSPSLSGAIRVNPWNIEATAEALNEAISMSEQEKHLRHEKHYRYVSTHDVAYWSKSFIQDLERACKDHFRRTCWGIGLGFGFRVVALDPHFTKLNMDSIVMAYERSESRAIFLDYDGTLVPQTSISRTPSAEVLRIINTLCSDRRNKVFLVSGRRRDKLGEWFSSCPDLGIAAEHGYFLRWTRDEEWQTCTQTSDFGWMEMAKPVMNLYTEATDGSYIDPKESALVWHHQDADPGFGSSQAKELLDHLESVLANEPVSVKSGQFIVEVKPQGVSKGVVAEKILVSMKERGKQADFVLCIGDDRSDEDMFENIADTIKKGMVATNTSLFACTVGQKPSKAKFYLDDTFEVVTMLSALADATEPEPETDLTDEFDELAVSVSSVDIDDEQTPSDKLIGG

SEQ ID NO: 604 - protein, 481 aa, Arabidopsis thaliana; identical to SEQ ID NO: 424

SEQ ID NO: 605 - protein, 475 aa, Salmonella enterica subsp. arizonae serovar 62:z4,z23:--
MAMSRLVVVSNRIAPPDNKGGAGGLAVGVLGALKAAGGLWFGWSGETGNEDEPLKKVTKGNITWASFNLSEQDYEDYYCQFSNAVLWPAFHYRLDLVQFQRPAWEGYMRVNALLADKLLPLIKENDIIWVHDYHLLPFASELRKRGVNNRIGFFLHIPFPTPEIFNALPPHDELLEQLCDFDLLGFQTENDRLAFLDSLSSQTRVTTRSGKHHIAWGKDFQTEVYPIGIEPDEIALQAAGPLPPKLVQLKAELKNVKNIFSVERLDYSKGLPERFLAYEALLENYPQHRGKIRYTQIAPTSRGEVQAYQDIRHQLETEAGRINGRYGQLGWTPLYYLNQHFDRKLLMKIFRYSDVGLVTPLRDGMNLVAKEFVAAQDPANPGVLVLSQFAGAANELTSALIVNPYDRDDVAAALNRALTMPLAERISRHAEMLDVIVKNDINRWQERFIHDLKEVTPRSAERRQQNNVATFPKLA

SEQ ID NO: 606 - protein, 130 aa, Pseudoalteromonas piscicida
EFDLLLFGIPTWYYGEAQCDWDDFFPELEEVDFEGKLVAIFGCGDQEDYAEYFLDAMGMINDIVTERGAIVVGHWSTDGYDFEASKAVVEDGKFVGLGIDEDRQPELTEQRVKQWCAQVYDEMCLSELED

SEQ ID NO: 607 - protein, 178 aa, Azoarcus sp. BH72
MAKIGIFFGSDTGRTRKVAKYIAKKLGEVAADPVNVNKATVEDFLAYDALIIGSPTLGDGQLPGLESGAQNESWAEFLPQLDGADMSGKVVAIYGLGDQDKYANEFCDAIGLLYDAVTTCGATVVGPWPTEGYSFKSSQAVIDGQFCGLALDNDNQAGLTDERVDTWLEQVKPALLGA

SEQ ID NO: 608 - protein, 529 aa, Magnaporthe grisea 70-15
MGSVEDETALPSGGRLLLISNRLPITIKRSDDGQYSFSMSSGGLVTGLSGLAKTTSFQWYGWPGLEVPDAEAGPVVQRLKNEYGAHPVFVDDELADRHYNGFANSILWPLFHYHPGEITFDESAWSAYKEVNRLFAQTVVKDVQDGDMIWVHDYHLMLLPEMLREEIGDSKKNVKIGFFLHTPFPSSEIYRILPVRQALLQGVLHCDLLGFHTYDYARHFLSSCSRILSAPTTPNGVQFAGRFVTVGAFPIGIDPEKFVEGLQKPKVQQRIAALTRKFEGVKLIVGVDRLDYIKGVPQKLHALEVFLTEHPEWIGKIVLVQVAVPSRQDVEEYQNLRAVVNELVGRINGKFGTIEFMPIHFLHQSVSFDELAALYAVSDVCLVSSTRDGMNLVSYEYIATQRDRHGVMILSEFTGAAQSLSGSLIVNPWNTEELANAIHDAVTMGPEQREANFKKLERYVFKYTSAWWGSSFVAELNRLAAGIEGADAEGSKTKIAIRGVGDAVADGAGKVADAVSSVLPGGDNKTEGN

SEQ ID NO: 609 - protein, 513 aa, Schizosaccharomyces pombe
MSDAHDTIKSLTGDASNSRRLIVVSNRLPITIKRKDNGTYDFSMSSGGLVSALSGLKKLMTFQWLGWCGQEIPEDEKPMIIQRLQDECSAIPVFLDDETADRHYNGFSNSILWPLFHYHPGEINFDEENWEAYRAANYAFAEAIVKNLQDGDLIWVQDYHLMVLPQMLRELIGDKFKDIKIGFFLHTPFPSSEIYRVLPVRNEILEGVLNCDLVGFHTYDYARHFLSACSRILNLSTLPNGVEYNGQMVSVGTFPIGIDPEKFSDALKSDVVKDRIASIERRLQGVKVIVGVDRLDYIKGVPQKFHAFEVFLEQYPEWVGKVVLVQVAVPSRQDVEEYQNLRAVVNELVGRINGRFGTVEYTPIHFLHKSVRFEELVALYNVSDVCLITSTRDGMNLVSYEYICTQQERHGALILSEFAGAAQSLNGSIVINPWNTEELANSIHDALTMPEKQREANENKLFRYVNKYTSQFWGQSFVGELQRIQHYSHPHPRRTNPILRTKSAQVLSMNSSS

SEQ ID NO: 610 - protein, 521 aa, Rigidoporus microporus
MPSFASLKSLVVLSLTSLSLAATVALDLHILNANLDPDGTGARSAVTAEGTTIAPLITGNIDDRFQINVIDQLTDANMRRATSIHWHGFFQAGTTEMDGPAFVNQCPIIPNESFVYDFVVPGQAGTYWYHSHLSTQYCDGLRGAFVVYDPNDPHLSLYDVDDASTVITIADWYHSLSTVLFPNPNKAPPAPDTTLINGLGRNSANPSAGQLAVVSVQSGKRYRFRIVSTSCFPNYAFSIDGHRMTVIEVDGVSHQPLTVDSLTIFAGQRYSVVVEANQAVGNYWIRANPSNGRNGFTGGINSAIFRYEGAAVAEPTTSQNSGTALNEANLIPLINPGAPGNPVPGGADINLNLRIGRNATTADFTINGAPFIPPTVPVLLQILSGVTNPNDLLPGGAVISLPANQVIEISIPGGGNHPFHLHGHNFDVVRTPGSSVYNYVNPVRRDVVSIGGGGDNVTFRFVTDNPGPWFLHCHIDWHLEAGLAVVFAEDIPNIPIANAISPAWDDLCPKYNANNPDSGLA

SEQ ID NO: 611 - protein, 147 aa, Bacillus anthracis str. Ames
MAKILIAYASMSGNTESIADLIKVSLDAFDHEVVLQEMEGMDAEELLAYDGIILGSYTWGDGELPFEAEDFHEDLENIDLSGKKVAVFGSGDTAYELFCEAVTIFEERLVERGAELVQEGLKIELAPEDEEDVEKCSNFAIAFAEKF

SEQ ID NO: 612 - protein, 878 aa, Debaryomyces hansenii
MTNALNEIENMSAFPSDGKTVSPKDYANNDKLKLSGRIINVMTSLPTQIVKKTNKSGNDNWDVEPVRGNSALYSSQFFLAQQTDWESHLVGWTGELINKSSNSKSIINENITDDPLYLNKEDKTSLEGKIRDANKSAHIHPVWLLRRDQERWRNYAENVLWPVFHYIQGEPSDGKDEASSWHDYVKFNEAYCQKIISIYKPGDVIWIHDYYLLLLPQLLRMEIPNAIIGLFMHAPFPSSEYFRCLSKRSHLLDGMLGADKIAFQSEAFQRHFSSCCTRLLGCEISKDKLMAYGSAISLETLPIGIDTKKIEYDAFSSDSGIEQKVRALGEIYADKKIIVGRDRLDTVRGVVQKLQAFEMFLQMYPEWRDKVVLIQVSSPGYSHSAKVEQKVTELVHHINSEYGDLNSTPILHYQKRINKDEYLALLRVADLALITSVRDGMNTTSLEFVLCQKENYSPLILSEFTGTASVLSEAILVNPWDSVGIAKTMNDCFYMSKDKKRALEERLYKQVTSNTIQNWTSNFITHLIDHVNNTHQTHYTPALNRPLLLNNYENSHRRLFLFDYDGTLTPIVKDPAAAIPSSRLNAVLDILSSDPKNQVWVISGRDQAFLDKWLGSKNIGLSAEHGCFLKDIGSTEWSNLSASFDMSWQTKVKEVFKEYTEKTPGSNTEQKKVALTWHYRRSDPELGKYQAEKCLKFLKETVATEYDVEVMPGKANIEVRPNFVNKGEIVKRLVLNPHGAKQIPHVVTNYNKDVPVDELPDFILCLGDDFTDEDMFKSLKDIEAEWSSKDHPTNQYGSHGVYPVAVGPASKQTIATSHLTEPSEVLETLGLLSGVVSLFESAGSVSLDDRGHLENSTSSNKSKSAIKEATKKEGSKSC

SEQ ID NO: 613 - protein, 543 aa, Arabidopsis thaliana; identical to SEQ ID NO: 560

SEQ ID NO: 614 - protein, 404 aa, Vibrio parahaemolyticus RIMD 2210633
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGNPVHYLCDEQSDWYPDLDDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAFELINQIPGVSCVKPKGAMYLFPKIDTKMYNIKNDQQMVLDFLKQEKVLLVQGSGFNWPKPDHFRIVTLPHVEDLETAIGRFERFLSTYSQ

SEQ ID NO: 615 - protein, 404 aa, Haemophilus influenzae Rd KW20
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPTIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 616 - protein, 524 aa, Trametes sp. C30
MGRLQRFSAFVPLTLSFISQASAAIGPVTDLTISDADISPDGFTRAAVVMNDQFPGPLIAGNKGDNFQINVIDNLSNSTMLTSTTIHWHGFFQKGTNWADGAAFVNQCPISAGNSFLYDFTATDQAGTFWYHSHLSTQYCDGLRGPMVVYDPDDPHASLYDVDDDSTVITLSDWYHTAARLGARFPAGADSTLINGLGRAAGGDADAALAVFNVTQGSRYRFRLVSLSCDPNFNFTIQDHNMTIIEVDGVNVEPVTVDSIQIFAGQRYSFVLTADQDIGNYWIQAVPNTGTVTTDGGVNSAILRYDTADPIEPDAADPTSSIPLVETDLVPLENLAAPGDPTVGGVDLAMNLEFDFNGTWFFINGEPFVPPSVPVLLQIMSGAQSAADLLPSGSVYTLPANSTIEISFPMNTTAAPGAPHPFHLHGHTFYVVRSAGSTEYNYVNPPQRDTVSTGTDGDNVTIRFTTNNPGPWFLHCHIDFHLDAGFAIVLSEDTPDAASANTPSSAWDDLCPTYNTDYPDGLGR

SEQ ID NO: 617 - protein, 774 aa, Physcomitrella patens subsp. patens
RLLVVANRLPVSATRLDGDKWDLQLSAGGLVSALLGVKQIFETRWIGWAGVSVHDERGRASLTEALALKGCVPVFLDDDTVDQYYNGYCNNVLWPLFHYIGLPQADRLAATRSLDSQYAAYQHANKLFAQVVFSQYQEGDVVWCHDYHLMCLPQELKTLNPRMKVGWFLHTPFPSSEIYRTLPLRSELLKAVLTADLIGFHTYDYARHFVSACTRILGLEGTPEGVEDQGKLTRVAAFPIGIDPERFIQALETEQVKLHVKELLRFFAGRKVMLGVDRLDMIKGIPQKLLAFEMFLEKNPEWREKVMLVQIAVPTRTDVHEYQRLTSQVHEIVGRINGRYGTVTFVPIHHLDRSLAFHELCALYASTDVALVTSLRDGMNLVSYEYVACQNFKNTEGVLVLSEFAGAAQSLGAGAILVNPWNIREMYIAIEEALKMSDEERKERHRHNFTHVTTHTAQAWAHNFVSELYDTIVEAELRTLNEPPNLPVDSAKESFLNSKNRLLVFGFNSTITATVEAPRRDQIKESKLGLHPGIKECLGTLCSDPNTDVVILSGSKRDTLEEVFGGFNIWLAAENGMYLRDLIGKWMPTMEHLNMDWKDSVQLVFDYFCARTPRSFVEKRETSLVWNYKYADLEFGRVQARNMLQHLWTGPISNAAVDVVQGQKSVEVRPIGVSKGAAIDRIVFEIIRSKHPSSSQTPNIQFDFVMCLGHFLSKDEDVYAYFDPDNAFDRDNRCNLVNVSPETYISCAVGKKHSSARYYLDTVNEVVSFVKSLA

SEQ ID NO: 618 - protein, 619 aa, Candida albicans SC5314
MRSLSIFSLVFLFFSTLITAKTHTWYYKTGWVNANPDGGFERPMIGFNDSWPLPTLRVKKGDTVNLYLINGFDDRNTSLHFHGLFQHGTNQMDGPEMVTQCPIPPGETFLYNFTVDDQVGSYWYHSHTSGQYGDGMRGVFIIEDDDFPYDYDEEVILTLGEHYHDFSDDLHKNFMSRYNPTGAEPIPSNILFNETRNNTWKVEPGKTYFVRIINIGRFVSQYVWMEDHEFTIVEVDGIYVEKNTTDLIYITVAQRYGVLITTKNSTDKNYAFMNRVDIDMLDVIPDELELNGTNYIEYNSKADKPEPYLLDSIDDYFDDFYLKPLSKEKLLDDADYTITVDVQMDNLGNGVNYAFFNNITYTTPRVPTLLSVLSAGDDASNELVYGTNTNSFVLQSGDVVDIVLNNLDTGKHPFHLHGHVFQLIERHEEIPETEDPVGYNASDHADWPEYPMLRDTVYVRPQSYIVMRFKADNPGVWLFHCHIEWHLDQGLAIQLIEDPQGIQKNTSQHITDNHKQICEKVGVSWEGNAAANSKDYLNLKGENVQHKRLPTGFTARGIVALVFSCIAGVLGLATIAYYGMNDIADVEERVARDLDVDFDEEDNEIVNEGSSSSGSNSKH

SEQ ID NO: 619 - protein, 882 aa, Emericella nidulans
MSLQQDPSKPDGRPGEVRFDSFTDASASNGSSNFNNASKTASALSEADKGTQSGSDLLHRLSLKEILTMRAPDFQKQYQGLNLSGRIISAAFCIPHKLYFRAGRDWELKPRPGSSALFDSFAYLASEKSGWSHTLVGWTGEVEPLNEGSNPLQALNSNANTNLPAALDNTSRSLSKGSAPVVPDISLLQSNSSVAETSTVGPDDRKRLEDQLSSSRHGKVVPVCLSDESDVPEDTIILGDQSRWRRYAEKELYALLHYKQNGPTDGRFERDSWTDYVRMNQLFAERILQEYKEGDIVWIHDYHLFLLPSILRQHVPNIYIGFYLHSPFPSSEYMRCLAKRKEILTGVLGANMIGFQTFSYSRHFSSCCTRVLGFESDSAGVDAYGAHVAVDVFPIGIDAEAIQKIAFENADTEKAVEGLRQLYAGKKIIVGRDRLDSARGVAQKLQAFETFLERFPEWRDKVVLIQVTSPTSVEEEKEEQKIASRISNLVSTINGRFGSLSFSPVKYYPQYLSPHEYFALLRVADVGLITTVRDGMNTTSLEYILCQQENHSPLILSEFSGTAGALSSAIHINPWDTIGVSEAINKALTESVADKKEQHLKLYKHVTTNTVSAWSNQFISRLLANLSSFDQSMATPALDRTKLLKQYRKSRKRLFMFDYDGTLTPIVKDPQSAIPSDRVLRTLKTLAADPRNAVWIISGRDQAFLDEWMGHIPELGLSAEHGCFIRMPRSDNWQNLAETTDMGWQKEVMEIYQHFTERTQGSFIERKKVALTWHYRRADPEYGAFQARECRKQLEEHVSKTWDVEVMAGKANLEVRPRFVNKGFIATRLVQAYEDGKVPEFILCSGDDFTDEGMLFPFLATPKLRHELLLTYLRYVPCLEEI

SEQ ID NO: 620 - protein, 176 aa, Photorhabdus luminescens subsp. laumondii TTO1
MAIIGIFFGSDTGNTENIAKKIQKILGSDIAEVHDIAKSSKEDIEQFDILLLGIPTWYYGEAQCDWDDFFPTLEEIDFEGKLVALFGCGDQEDYAEYFCDAMGTIRDIIEPRGAIIVGHWPTEGYHFEESKGLADDSHFIGLAIDEDRQPELTEERVNAWTKQIYEELSLSEILAG

SEQ ID NO: 621 - protein, 462 aa, Oryza sativa Japonica Group
MRVSRLCNSTDIIAVNGLLPGPMIEVNEGDAVAVEVINGSPYNLTIHWYVTNPCASETSEDTNEQIKYHKVGEWWSRNVVDIESDAVSSGQLPRESDAFTVNGVTGELYQCANDTFTVDVQPNTTVLLRVINAGLNTHLFFKVAGHAFTVVAVDACYTANYTTDTLVLAPGHTVDALMVTNASAGSYYMAVQAYDSLSPTTMAVTDDTTATAIVHYNTTSTKKNATPVMPTMPQSSDSATANAFYFGLRGPPSPSAPAVPTKVDVNMTIELGLGQLPCDSTQSSCSGKSVAAAMNGVSFRLPSQMSLLEAQFNRTPGVYTADFPDAPQPSGTPMVEGTKVRRLKYNSTVEIVLQNPTAFPSENHPIHLHGFNFFVLAQGLGNFTPGNVSGYNLVDPVSRNTLAVPTGGWAVIRFVANNPGMWFFHCHLDAHVPMGLGMVFAVDNGTTPDSFLPPPPADLPKC

SEQ ID NO: 622 - protein, 427 aa, Mycobacterium abscessus
MSTDNLPIDVPPRVPGLSPRQHQRVFAQSTKLQDVLYEIRGPVHAHAARLEAEGHRILKLNIGNPAPFGFEAPDVIMRDIIQALPYAQGYSDSKGILPARRAVVTRYELVDGFPYLDVDDVFLGNGVSELITMTTQALLDNGDQVLIPAPDYPLWTAATSLAGGTAVHYLCDETNGWMPDIEDLESKITERTKALVIINPNNPTGAVYSREILTKMVELARKHQLLLLADEIYDKILYDDAEHISVASLAPDLLCFTFNGLSKAYRVAGYRSAWLAITGPKDHAASLLEGVNLLANMRLCPNVPAQHAIQVALGGHQSIEDLVLPGGRLLEQRDVAWTKLNEIPGVSCVKPQGALYAFPRLDPEVHHIHDDDQLVLDLLLNEKILLTQGTGFNWPEPDHLRIVTLPWARDLAVAIERLGNFLASYRQ

SEQ ID NO: 623 - protein, 521 aa, Ganoderma fornicatum
MARLQSLLPYFSLLLAAPAYAAIGPVANLTISDAEIAPDGFTRAAVVVNGVSPGPLIKGNKGDRFQINVVNQLTNHTMSKTTSIHWHGLFQEGTNWADGPAFVTQCPIASGNSFLYDFRVPDQAGTFWYHSHLPTQYCDGLRGPLVVYDPHDPLAHMYDVDDDSTVITLTEWYHTAAQLGRRFPVGDANSTLINGLGRSTATPTADLAVVNVTQAKRYRFRLVSMACDPSFNFSIVGHDLTVIEADGVETQPVTVSTITIFAAQRYSFVLTANQMIDNYWIRANPAFGDVGFAGGLNSAILRYDGAAPIEPVTSQQSTQILLNETDLHPYVPKKTPGKPKKGGVDLALNMVFGFNTTNFFINNATFVPPTVPVLLQILSGAQSAQDLLPAGSVYTLPKNASIEITFPANANAAGSPHPLHLHGHTFAVVRSAGSTAYNYDNPVWRGTVSTGLASANDNVTIRFQTDNPGPWFLHCHIDFHLNAGFAVVLAEDVPDVAYANPVPQEWKNLCPTYDALSPNDQ

SEQ ID NO: 624 - protein, 430 aa, Mycobacterium avium subsp. paratuberculosis K-10
MDSDGTIGGVTTHQLPVHSSAHHRQQRTFAQSSKLQDVLYEIRGPVHQHAARLEAEGHRILKLNIGNPAPFGFEAPDVIMRDMIQALPYAQGYSDSQGILPARRAVVTRYELVDGFPRFDVDDVYLGNGVSELITMTLQALLDNGDEVLIPSPDYPLWTASTSLAGGTPVHYLCDETQGWQPDIADLESKITERTKALVVINPNNPTGAVYSGEILSQMVDLARKHELLLLADEIYDKILYDDAKHINVASLAPDMLCLTFNGLSKAYRVAGYRAGWLAITGPKDHAGSFIEGINLLANMRLCPNVPAQHAIQVALGGHQSIEDLVLPGGRLLEQRDVAWSKLNEIPGVSCVKPAGALYAFPRLDPEVYDITDDEQLVLDLLLQEKILVTHGTGFNWPAPDHLRIVTLPWARDLAAAIERLGNFLVGYRQ

SEQ ID NO: 625 - protein, 757 aa, Marinobacter sp. ELB17
MLLATDLDGTFLAGDPENRLKLYRLIVAHPEIDLVFVTGRGLEAVLPLLSDPTIPQPDYIICDVGCTVVHGASQQAIQPLQGEIDELWPGEQVVESALSSFEGLQRQEVPQERRVSYFCDNDLVSEDMLARVSALSCDVLFSAGKYLDILPRGVNKGRTLSRLVEHLGVDPESVLVAGDTLNDLSMYQHEFKGVCVGESEAGLLAATEHQARVLHAGASGCGGILEAFEHFGYLGHLGIEAEIPDYMNRGKSDLVIVYHRLPYEEVVENGELIRRRPKSPNGIIPTLLSFFSDGKAGSWVAWSVDDPDLGPFQTHTEVDTSRYEKLVAARVALSEEDVEIFYKRFSKEAFWPTLHTFWERATFRDDHWQVYLKVNRLFAERAAEEAAENAVVWIHDYNLWMVPAYLREMRPDLTIAFFHHTYFPSADVFNVLPWRREIIGSLLQCDHIGFHIPRQAENFVDVARGVTPLEVTHKMGCAPRFLTYGCAVGLDEMSTEITVNDRKIGLGAHPVGLDLNRVRTALSDQSVIAQMETLREEFKDVRLILSVERLDFTKGIIEKLQAYERILNEHPELKTKVTLMLICVPAAAGMTIYEELLSQIEQTVGRINGQFAQVGWTPVQFFFRALPFEELVAYYTIADVMWITPLRDGLNLVAKEYIATQGLTQGSGVLVLSEFAGAAAELRGAILANPHHPQDLADTCYYALAISRSEARNRLSEAFEVVCRYDIEYWGREFINEVERRRATKLNKILAIGHRAA

SEQ ID NO: 626 - protein, 521 aa, Ganoderma fornicatum
MARLQSLLPYFSLLLAASAYAAIGPVANLTISDAEIAPDGFTRAAVVVNGVSPGPLIKGNKGDRFQINVVNQLTNHTMSKTTSIHWHGLFQEGTNWADGPAFVTQCPIASGNSFLYDFRVPDQAGTFWYHSHLSTQYCDGLRGPLVVYDPHDPLAHMYDVDDDSTVITLTEWYHTAAQLGRRFPVGDANSTLINGLGRSTATPTADLAVVNVTQGKRYRFRLVSMACDPSFNFSIDGHDLTVIEADGVETQPVTVSTITIFAAQRYSFVLTANQTIDNYWIRANPAFGDVGFAGGLNSAILRYDGAAPIEPVTSQQSTQILLNETDLHPYVPKKTPGKPKKGGVDLALNMVFGFNTTNFFINNATFVPPTVPVLLQILSGAQSAQDLLPAGSVYTLPKNASIEITFPANANAAGSPHPFHLHGHTFAVVRSAGSTAYNYDNPVWRDTVSTGLASANDNVTIRFQTDNPGPWFLHCHIDFHLNAGFAVVLAEDVPDVAYANPVPQEWKNLCPTYDALSPNDQ

SEQ ID NO: 627 - protein, 481 aa, Glycine max
MPPKPLDYGSINENVKKSQYAVRGELYLRASELQKEGKKIIFTNVGNPHALGQKPLSFPRQVVALCQAPFLLDDPNVGLLFPADAIARAKHYLSLTSGGLGAYSDSRGLPGVRKEVAEFILRRDGYPTDPELIYLTDGASKGVMQILNTIIRGQDDGILVPVPQYPLYSATIALLGGTLVPYYLEETANWGLDVNELRQSVEQARFKGITVKAMVIINPGNPTGQCLSEANLREVLQFCYQENLALLGDEVYQTNIYQDERPFISSRKVLMELGPPISKEVQLISFHSVSKGYYGECGQRGGYFEMTNIPPETVDEIYKVASISLSPNVPAQIFMGVMLNPPQPGDISYDKFVRESTGILESLRRRARIMTDGFNSCRNVVCNFTEGAMYSFPQIRLPPRALEAAKQAGKVPDVYYCLKLLEATGISTVPGSGFGQKEGVFHLRTTILPAEEDMPDIMDSFKKFNDEFMEQYEDDRGYSRL

SEQ ID NO: 628 - protein, 680 aa, Triticum aestivum
  misc_feature (186)..(186): Xaa can be any naturally occurring amino acid
  misc_feature (509)..(509): Xaa can be any naturally occurring amino acid
DYVWVHDYHLMALPTFLRRRFNRLRIGFFLHSPFPSSEIYRTLPVREEILKALLNCDLIGFHTFDYARHFLSCCSRMLGIEYQSKRGYIGLEYFGRTVGIKIMPVGIHMDQLQAVLCLPDRQWRVSELQQQFEGKTVLLGVDDMDIFKGINLKLLAFENMLRTHPKWQGRAVLVQIAKPVRGKGKXDLEAIEAEIRESYNRINGEFGRSGYSPVVFIDRDVSSVEKSAYYTIAECVVVTAVRDGMNLTPYEYIVCRQGTPRSESSSEVTGPKKSMLVVSEFIGCSPSLSGAIRVNPWNVEATAEAMNEAISMSDQEKQLRHEKHYRYVSTHDVAYWSKSFIQDLERACKDHFRRTCWGIGLGFGFRVVALDPHFTKLNMDSIVMAYERSESRAIFLDYDGTLVPQTSINKTPSAEVLRIINTLCSDERNIVFIVSGRGRDKLGEWFSSCPKLGIAAEHGYFLRWSRDDEWQTCAQASDFGWMEMAEPVMNLYTESTDGSYIENKESALXVWHHQDADPGFGSSQAKEMLDHLESVLANEPVSVKSGQYIVEVKPQGVSKGVIAENILISMKERGKQADFVLCIGDDRSDEDMFENIADIIKRGMVAPKTPLFACTVGQKPSKAKFYLDDTFEVATMLSALAEATDPEPMTGYTDELATSMSSIDIGGEQSQSRGRPFDGL

SEQ ID NO: 629 - protein, 174 aa, Prochlorococcus marinus str. MIT 9515
MTVGIYYATTTGKTEDVADRLHNFISSAESPKDVSDVDDLSEFEGLDGIICGIPTWNTGADEERSGTAWDSILEDIGELSLSGKKVAIFGLGDSSTYTENYCDAMEELHSYFTKAGADMVGYVDKSSYTFDESKSVIGESFCGLPLDEDSESDLTDSRLETWASQLKGEIPSLG

SEQ ID NO: 630 - protein, 86 aa, Arabidopsis thaliana
MYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 631 - protein, 914 aa, Zea mays
MMSRSYTNLLDLAEGNFAALGPAAGAGGGGRQRQGSFGLRRMSRVMTVPGTLSELDGEDESEPAATSSVASDAPSSVAADRLIVVSNQLPIVARRRPDGRGWSFVWDDDSLLLQLRDGIPEDMEVLFVGSLRADVPVAEQDEVSQALLDRFRCAPVFLPDRLNDRFYHGFCKRQLWPLFHYMLPFSSSASAAGTTSSSVATSSPGNGRFDRSAWEAYVLANKFFFEKVVEVINPEDDYVWVHDYHLMALPTFLRRCFNRLRIGFFLHSPFPSSEIYRTLPVREEILKALLNCDLIGFHTFDYARHFLSCCSRMLGIEYQSKRGYIELDYFGRTVGIKIMPVGVHMGQLESGLRLPDREWRLSELQRQFQGKTVLLGVDDMDIFKGINLKLLAFENMLRTHPKWQGRAVLVQIANPARGRGKDLEAIQAEIEESCQRINGDFGQSGYSPVVFIGRDVSSVEKIAYYTIAECVVVTAVRDGMNLTPYEYVVCRQGAPGSQSVSEVSGPKKSMLVVSEFIGCSPSLSGAIRVNPWNIEATAEAMNEAISMPEQEKQLRHEKHYRYVRSHDVAYWSKSFIIDLERVCKDHFKRTCWGIGLGFGFRVVALDPHFTKLNMDSIINAYELSESRAILLDYDGTLVPQTSLNKEPSPQVLSIINTLCSDSRNIVFLVSGRDKDTLGKWFSSCPRLGIAAEHGYFLRWSREEEWQTCTQALDFGWMQMAKPVMNLYTEATDGSYIEAKESALVWHHQDADLGFGSSQAKEMLDHLESVLANEPVSVKSGQFIVEVKPQGISKGIVAERILASVKERGKQADFLLCIGDDRSDEDMFENIADIIGRNLVAPRTALFACTVGQKPSKAKFYLDDTFEVVTMLSALADATGPELETDSADESVAYISSLDIGDEQSESSDKPVEGS

SEQ ID NO: 632 - protein, 170 aa, Cyanothece sp. ATCC 51142
MSMIGLFYGTETGKTETTAEMIQSELGGDKVVELMDIADCEATDLEKYDYLIIGCPTWNVGELQSDWESIYDDLDTIDFKGKQVAYFGTGDQIGYSDNFQDAMGMLEEKISQLGGKTVGHWSVDGYDFDDSKAVKNGKFVGLALDEDNQSDLTEERIKTWVAQLKQEFNL

SEQ ID NO: 633 - protein, 607 aa, Gaeumannomyces graminis var. graminis
MKFLIVSLFALVCGSAALATPVNSSVSAWSGQHHPKPHHPHQPPHSGCKNGPKSRNCWGKHSIDTNYYETAPDTGVTREYWLSVEEGICNNDGYKRYCQTFNGSFPGPLIWANWGDNLVIHVTNNMKTNGTSIHWHGLHQRGSVEYDGVPGVTQCPIAPGKSLTYKFRVTQYGTTWYHSHFSLQYAEGLFGPMIFYGPTTANYDEDLGTLFLQDWDHGTAWHGWDNVASKGAGPLPANGLINGTNTFDCKNSTDTNCVGGGKKFSANFKKGKKHLIRIINNSADAHFQFSIDGHDLTVVANDLVPIKPFKTKSVRVSIGQRYDVIVEANAKPGNYWLRSGMSCVPGDTGALRKRVTGIIRYDKKSKADPKTTSDVVVDETCSDEDPKKLVPHLALDVTHTGEIVRSDLGFKPNGTPAEGQNWFQWTLNNSSLVLDWHDPTLERIFDGQSIFPTDYNVIKADCQLWPQQAMVHTGDSEQRPPTDPLPSHRLAHPIHLHGHDFWVLSQSKAKWDGTPRGFDTKNPARRDTAMLPEKGHLAIAFQLDNPGAWLVHCHIAWHAGQGLSLEFVESQDRIALGMPNHDVFRQTCREWDAVRTKMPFPQHDSGI

SEQ ID NO: 634 - protein, 477 aa, Oryza sativa Indica Group
MSYNHSPSITAETINQKVRIFTYEPCGEIVRHARIIYCNLGNPQALGQRPINFFREVLSLCDNPSLIDRDEARALFSPCALKRARKIIESLPGRDSGSYTSSQGVRGLREAVADGIAARDGFPSKPDNIFLTDGASSAINMMMQILIRSHEDGILCPLPEYPLYSASIILHGGTMVPYNLTEDSGWGLEIFEVKRCLEDARASGLTIRAMVVINPGNPTGQVLSITNQEEIVEFCRKEGLVILADEVYQENVYTENKRFNSFKKVARSLGYDHHDLSIVSFHSVSMGYYGECGRRGGYMEICGFGDDVIDEMYKLASLTICPNIAGQILISLVMDPPKLGDEAFEIFMVEKEETYSSLLKRAKALQKAFSGLEGVSCNKFEGAMYLFPRLRLPQAAIKAAQLEGVSPDVFYAHRLLGATGIAVVPGSGFHPDLVSSCKKVSGTSHIRCTILPGEETITAMVPRLQAFHEAFMDEFRG

SEQ ID NO: 635 - protein, 404 aa, Neptuniibacter caesariensis
MPVIRKSNKLINVCYDIRGPVLQEAKRLEEEGQRILKLNIGNPAPWGFEAPEEIVQDVILNLPASQGYCDSKGLFSARKAVMQECQKNGIKNVGIEDIYIGNGVSELIVMAMQGLLNDTDEMLIPAPDYPLWTAAVSLSGGNPIHYHCDEEKDWAPDIEDMRSKITERTKGIVVINPNNPTGAVYPKPVLEQIIELAREHNLIVFADEIYDKILYDEAEHTSMASLADDVLCISFNGLSKSYRAAGFRSGWMIVSGPKHNARDYIEGLEMLSSMRLCSNVPTQHAIQTALGGYQSVNELIVPGGRLYEQRNLAWEMLNEIPGVSCTKPEGALYMFPKLDPDVYPIKNDEKMALDLLLQQKVLIVQGSGFNLPDTQHFRLVILPREDELRDAIERIATFLKTYEQ

SEQ ID NO: 636 - protein, 180 aa, Azotobacter chroococcum (strain mcd 1)
MAKIGLFFGSNTGKTRKVAKSIKKRFDDETMSDAVNVNRVSAEDFAQYQFLILGTPTLGEGELPGLSSDCENESWEEFLPKIEGLDFSGKTVALFGLGDQVGYPENFLDAMGELHSFFTERGAKVVGAWSTDGYEFEGSTAVVDGKFVGLALDLDNQSGKTDERVAAWLAQIAPEFGLSL

SEQ ID NO: 637 - protein, 477 aa, Escherichia coli CFT073
MMTMSRLVVVSNRIAPPDEHAASAGGLAVGILGALKAAGGLWFGWSGETGNEDQPLKKVKKGNITWASFNLSEQDLDEYYNKFSNAVLWPAFHYRLDLVQFQRPAWDGYLRVNALLADKLLPLLQDDDIIWIHDYHLLPFAHELRKRGVNNRIGFFLHIPFPTPEIFNALPTYDTLLEQLCDYDLLGFQTENDRLAFLDCLSNLTRVTTRSAKSHTACGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLMKIFRYSDVGLVTPLRDGMNLVAKEYVAAQDPANPGVLVLSQFAGAANELTSALIVNPYDRDEVAAALDRALTMSLAERISRHAEMLDVIVKNDINHWQECFISDLKQIVPRSAESQQRDKVATFPKLA

SEQ ID NO: 638 - protein, 624 aa, Cryptococcus neoformans var. neoformans JEC21
MRGLAKLFFLSCSFVSLVSSEKTDESPTAVSDNYMPKATATIDPSVFALSNDFEITDVPTTREYTFDIANAFASPDGYEREVYVVNNMFPGPVIEANTGDTIIVHVNNHLDEGQSLHWHGLRQLGTAFMDGVPGITQCPIPPGGSFTYNFTVSHQSGTYWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISIAPGERYSAIINTNEGKEGDAFWLRTSVALSCMFGAVSQEGLAVVRYTGNGIVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPAKRSSSPSIQSSKTSSFQYLREVKGKVVKRRGAREA

SEQ ID NO: 639 - protein, 520 aa, Trametes versicolor
MSRFHSLFAFVVASLTAVAHAGIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 640 - protein, 518 aa, Coprinopsis cinerea okayama7#130
MLLLSSLLIAQFVPRALGAIGPNSNLYVANKDIAPDGFTRSGVLVGTNANNLAFPGPVIRANKNDHYNLNVIDELTDPTMLRTTSIHWHGFFMNGTAWADGPAGVTQCPIAPGHSFRYKFQAKNQAGTFWYHSHHLSQYCDGLRGVMVVYDRHDPHRHLYDVDNEQTIITLADWYHTPAPSAGLVPTPDSTLINGKGRYVGGPMVPLSVIHVRRGRRYRFRLVSLSCDPFYTFSIDGHSMTIIEADGISTEPLIVDSIQIFAGQRYSFVLNANRPVDNYWVRANPNLGDIGYAGGINSAILRYVGAPNAEPTTTESPSLNPLLETNLHPLHSPAAPGNPTPGDVDVAINLDVVFDFASLKFQVNGATFDEPPLPVMLQIMSGAHTPQDLLPAGGVYTLPKNAVVELSMPGGSVGSPHPMHLHGHAFSVVRSAGSSTYNFVNPVQRDVVSIGQAGDNVTIRFRTDNSGPWILHCHIDWHLVLGLSVVFAEDVPTIAASNPPPAWHDLCPIYEELPPGTR

SEQ ID NO: 641 - protein, 415 aa, Frankia sp. CcI3
MEFTQSDKLADVCYDVRGPVLDEATRLEAAGSRILKLNIGNPAPFGFSAPPEVLEAVVANLADAQGYSDSKGLLAAREAVVRYHLRKGVTGIDPGGVYLGNGVSELIMMSLQALLNNGDEVLLPAPDYPLWTAVVSLCGGRPVHYLCDESAGWAPDLDDIAAKVTPRTRAIVVINPNNPTGAVYDRQVLENIVEVARRHHLMLLSDEIYDRILYEDAEHIATAALAPDLVCMTFNGLSKSYRLAGFRAGWMVMSGPRGHASSYIEGVNILANMRLCANAPGQFATVAALTEDGGAGDLVLPGGRLREQRDTVVKLLNDIPGVSCVPPRGALYAFPRLDPAVYPIRDDERFVLDLLLAEKILLVQGSGFNWPHPDHVRIVTLPAVDDLTDAIGRIDRFLASYKRPSQQQCPSQRRN

SEQ ID NO: 642 - protein, 890 aa, Candida glabrata CBS 138
MTVPATKKQRIINCVSQLPYKIQLGETNDDWKITHVTGNSALYSSLDYLNYDLQGEVEHHVVGWTGEVTREASVPNFTKEDKDKHDASEEDPMYLTKEQISGLTSTLQDQMKVEDSNSTVHPVWLLRRDQSRWRSYAEKVIWPTFHYILNPSSANIQQENNWWYDYVKFNEAYANKIAEIYQKGDIIWIHDYYLLLLPQLLRMRYDQDVAIGYFHHAPWPSHEYFRCLPRRKQILDGLLGANKICFQNESFSRHFVSSCKRLLDSSAKKTKNADGFEQYQISAYGGDLIVDSLPIGVNTKQLLKDAFTKDIDSKVLAIKQAYQNKKIIIGRDRLDPVRGVLQKMRAFETFLEMYPYWRDQVVLIQVSSPTANRNSPQTIKLEQQVNELVNSINSKYGSLNFSPVQHYYMRIPKDVYLSLLRVADLCLITSVRDGMNTTALEYVTLKSNKSSANALSYGNPLVLSEFSGSSTLLKDAILVNPWDSVAVAKSINMALNMTKDEKSALEDKLWSEVPTIQDWTDKYLKSLKEIIHDSSLGTPSADKRITPALNRPILLENYKQAKRRLFLFDYDGTLTPIVQDPAAAIPTARLYSILQKLAADPKNQIWIISGRDQKFLNKWLGSKLPQLGLSAEHGCFMKDIGNEDWVNLTEKVDMSWQARVNDVMEDFTRRTPGSFIERKKVALTWHYRRAVPELGEFHASELQKELLKFTDDSDLEVMEGKANIEVRPRFVNKGEIVKRLVWHEHGKSQDMLKGINDTLPITEMPDFILCLGDDFTDEDMFRQLNTIESVWDKKFPDDRNNFGHFGFYPVTVGSASKKTVAKAHLTDPQQVLETLGLLVGDVSLFQSAGTVELDARGHVKNSESSLKSEQATAQYVLKRTASSQNVKKDK

SEQ ID NO: 643 - protein, 519 aa, Trametes versicolor
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWADGPAFVNQCPIAPGHSFLYDFHVPDQAGTFWYHSHLSTQYCDGLRGPFVVYDPKDPHASRYDVDTESTVITLTDWYHTAARLGPRFPLGADATLINGLGRSASTPTAALAVINVQHGKRYRFRLVSISCDPNYTLSIDGHNLTVIEVDGINSQPLLVDSIQIFSALDYSFVLNANQTVGNYWVRANPNFGTVGFAGGINSAILRYQGAPVAEPTTTQTPSVIPLIETNLHPLARMPVPGSPTPGGVDKALNLAFNFNGTNFFINNASFTPPTVPVLLQILSGAQTAQELLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLEAAFAIVFAEDVADVKAANPVPKAWSDLCPIYDGLSEANQ

SEQ ID NO: 644 - protein, 520 aa, Trametes versicolor
MGRVSSLCALTAVIHSFGRVSAAIGPVTDLTISNADVSPDGFTRAAVLANGVFPGPLITGNKGDNFQINVVDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPVGSDSTLINRLGRFAGGDSTDLAVITVDQGKRYRMRLLSLSCYPNYVFSIDGHNMTIIEADAVNHEPLTVDSIQIYSGQRYSFVLTADQDIDNYFIRALPSAGTTSFDGGINSAILRYSGASEVDPTTTETTSVLPLDEANLVPLDSPAAPGDPNIGGVDYALNLDFNFGGTNFFINDVSFVSPTVPVLLQILSGTTSAADLLPSGSLFALPSSSTIEISFPITATNAPGAPHPFHLHGHTFSIVRTAGSTDTNFVNPVRRDVVNTGTAGDNVTIRFTTDNPGPWFLHCHIDFHLEAGFAIVFSEDTADVSNATTPSTAWEDPCPTYNALDSSDL

SEQ ID NO: 645 - protein, 527 aa, Trametes versicolor
MGKFHSFVNVVALSLSLCGRVFGAIGPVADLTISNADVTPDGITRAAVLAGGVFPSPLITGNKGDEFQINVIDNLTNETMLKSTTIHWHGIFQAGTNWADGAAFVNQCPIATATSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHESLDVDSIQIFAGQRYSFILNANQSIDNYWIRAIPNTGTTDTTGGVNSAILRYDTAEEIEPTTNATTSVIPLTETDLVPLDNPAAPGDPQVSGVDLAMSLDFSFNGSNFFINNETFVPPTVPVLLQILSGAQDAASLLPNGSVYTLPSNSTIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTTWSDLCPTYGALDSSDL

SEQ ID NO: 646 - protein, 497 aa, Brassica juncea
MVALTAEKQDQNLLSRMAAGDGHGENSAYFDGWKAYEENPFHPINRPDGVIQMGLAENQLCGDLMRKWVLEHPEASICTAEGVNQFSDIAIFQDYHGLPEFRQAVAKFMEKTRNNKVRFDPDRIVMSGGATGAHETVAFCLANTGEGFLVPTPYYPGFDRDLRWRTGVNLVPVTCHSSNGFKITVEALEAAYENARVSNIPVKGLLITNPSNPLGTTLDRDCLKSLVNFTNNKGIHLIADEIYAATTFGQSEFISVAEVIEEVPHSNRDLIHIVYSLSKDMGLPGLRVGIVYSYNDRVVQIARKMSSFGLVSSQTQHLIAKMLSDEDFVDEFIRKSKLRLAARHAELTTGLDGLGIGWLKAGAGLFIWMDLRNLLKTATFDSEMELWRVIATNKVKLNVSPGGSCHCNEPGWFSMFANMDHKTMETALERIRVFTSQLEEESLKQTKPMAAPTVMAKKKMCWQSSLRLSFKDTRRFEEGFFSPHSPVPHSPLVRAQI

SEQ ID NO: 647 - protein, 468 aa, Rhizobium leguminosarum bv. viciae 3841
MSRLVVVSNRVPMPAKDGSAAAGGLAVALQAALQERGGIWMGWSGESSGDREPGPLSQLQKGNITYALTDLTDTDVEEYYRGFANRVLWPICHYRLDLAEYGRKEMAGYFRVNRFFAHRLAPMIEPDDIIWVHDYHLIPLAAELRQMGLKNRIGFFLHIPWPPADILVTMPVHEEIMRGLSHYDLVGFQTDYDLQNFAGYLRREGIGDDLGNGLFDSHGRIFKAGAYPIGIETAGFAEFAERAANNIMVQKTRRSVEGRDMIIGVDRLDYSKGIIQRLEAFETFLTSNPAYQNKVTYLQVTPKSRSEVPEYEHMQKMVAEQAGRVNGAIGTVDWVPIRYVNRSISRNVLAGIYRLATIGLVTPLRDGMNLVAKEYVAAQDPDRPGVLVLSRFAGAARELKGALLVNPYDVEGTANAIAKGLSMSLEERRDRWSMMMEHLLSHDVSLWCENFLGDLVLAPELRPEHDPG

SEQ ID NO: 648 - protein, 403 aa, Pseudomonas syringae pv. phaseolicola 1448A
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAMHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPIFNDEKFVLDLLLSEKLLVVQGTAFNWPYPDHFRVVTLPRVDELEQAIGRIGNFLKGYRQ

SEQ ID NO: 649 - protein, 278 aa, Mangifera indica
FQDYHGLPEFRNAVANFMARVRGNRVKYEPDRIVMSGGATGAHETVAFCLADPGEAFLVPTPYYPGFDRDLRWRTGVQLFPVVCDSSNNFEITREAVEAAYEKAQEDHIRIKGLLLTNPSNPLGTCLDRETLRSLVSFINEKNIHLVCDEIYAATVFMGQPDFISISEIIEEDIHCNRNLIHLVYSLSKDLGFPGFRVGIIYSYNDTVVSCARKMSSFGLVSSQTQHLIASMLSDDEFVDRFITESAERLAKRHRAFTWGLFQVGIGCLKSNAGLFCW

SEQ ID NO: 650 - protein, 491 aa, Candida glabrata CBS 138
MTQIDKKEVSGNIIVVSNRLPVTISKDDTGKYQYKMSSGGLVTALQGLKKTATFKWYGWPGLEIPDDEKEQVKQDLLEQFNAVPVFLSDEVADLHYNGFSNSILWPLFHYHPGEINFDENAWLAYNEANRAFAEVIFETMQDDDLIWVHDYHLMLLPQMLQEEITKRKLRNVKLGWFLHTPFPSSEIYRILPVRQEILRGVLSCDLLGFHTYDYARHFLSSVQRVLNVNTLPNGVEYQGRFVNVGAFPIGIDVSTFQDGLLKQQVKDRISQLKETFKGQKIIIGVDRLDYIKGVPQKLHAMEVFLSEHPEWRGKVVLVQVAVPSRGDVEEYQYLRSVVNELVGRINGQFGTAEFVPIHFMHKSVPFEELISLYAVSDVCLVSSTRDGMNLVSYEYIACQEETKGSLILSEFAGAAQSLNGAIIVNPWNIDEMSDAINEALTLPEVKREVNWEKLFKYISKYTSAFWGENFVHELYNTSSSSGSIKSSEEKH

SEQ ID NO: 651 - protein, 533 aa, Toxicodendron vernicifluum
VDVHNYTFVLQEKNFTKWCSTKSMLVVNGSFPGPTITARKGDTIFVNVINQGKYGLTIHWHGVKQPRNPWSDGPEYITQCPIKPGTNFIYEVILSTEEGTLWWHAHSDWTRATVHGALVILPANGTTYPFPPPYQEQTIVLASWFKGDVMEVITSSEETGVFPAAADGFTINGELGDLYNCSKETTYRLSVQPNKTYLLRIVNAVLNEEKFFGIAKHTLTVVAQDASYIKPINTSYIMITPGQTMDVLFTTDQTPSHYYMVASPFHDALDTFANFSTNAIIQYNGSYKAPKSPFVKPLPVYNDIKAADKFTGKLRSLANEKFPVNVPKVNVRRIFMAVSLNIVKCANKSCNNNIGHSTSASLNNISFALPQTDVLQAYYRNISGVFGRDFPTVQKKANFSLNTAQGTQVLMIEYGEAVEIVYQGTNLGAATSHPMHLHGFNFYLVGTGAGTFNNVTDPPKYNLVDPPELNTINLPRIGWAAIRFVADNPGVWFLHCHFERHTTEGMATVVIVKDGGTTNTSMLPSPAYMPPCS

SEQ ID NO: 652 - protein, 498 aa, Hortaea acidophila
MAFLINNQFPGPMIKANWGDTVVVKLTNLLPNSIDNGTSLHFHGVRQNGTNEYDGVSSITQCPLAPGDTMTYTWRATSYGSSWWHSHFSLQTYEGMFGPLVIEGPSTLSYDEEQFVILQDWNHATADSLFDDSQVVVPGVRGGGLTLDTGLINGKNVWGNGGEYWSMTVTPGKSYRLRVLNAAIQSTFKFHIDGHSFQVIAMDFVPIHPYTTDIVSVNIGQRYDLILTANQAPANYWIRSDNQQPCGQLEQPNVQAILNYEGVKFATPTTTGLNYQPDCLDEPSASLVPYLAQDAGAQSAGEFVETSIIAANGAVPNLYKWTLSGSTFQANWNDPTLFSIWYDGDVPQYGGDLTVELPNAGEWVYFVIDSPMPLPHPIHLHGHDFLLLASGVGTYSADVPLQLTNPPRRDVAVMPADPLTGSGGYLVVAYQVSNPGVWLMHCHIGWHNTMGFALQIVEMIDSIKIENTCQLQETCVNWLNYANANSIFDAPFDDGSGG

SEQ ID NO: 653 - protein, 886 aa, Vitis vinifera
  misc_feature (182)..(182): Xaa can be any naturally occurring amino acid
  misc_feature (432)..(432): Xaa can be any naturally occurring amino acid
  misc_feature (663)..(663): Xaa can be any naturally occurring amino acid
MMSRSYTNLLDLATGNFPAIGRERKRLPRVMTVPGNVYELDDDQANSVSSDNPSSVAQDRLIIVANQLPVKANRRADDRGWVFSWNEDSLLLQLKEGLPEDMEVLYVGSLRVDVDLEEQEEVSQILLETFKCVPTFLPHDVLEKFYHGFCKKLLWPLFHYMLPFSADHGGRFDRSMWEAYVXANKLFSQKVIEVINPDDDYVWIHDYHLMVLPTFLRRHFNQLRMGFFLHSPFPSSEIYRTLPVREEILKALLNSDLIGFHTFDYARHFLSCCSRMLGLEYQSKRGYIGLEYYGRTVGIKIMPVGIHMGRIASVMKLADKQKKVGELKQQFEGKTVLLGVDDMDIFKGINLKLLAMEQLLQQHSKWQGKAVLVQIANPARGKGADLEEIQAEIRESCRRINEEFGEPGYEPIVFVDRPVSISERIAYYSIAXCVVVTAVRDGMNLTPYEYIVCRQGTDDSESSSDLSGPKKSMLVLSEFIGCSPSLSGAIRVNPWNVEATAEAMNEAISMSQSEQLLRHEKHFRYVSTHDVAYWSRSFLQDMERTCSEHFRRRCWGIGLSFGFRVVALDPNFRKLSMEAIVSAYCRAKSRAILLDYDGTVMPQNSINKAPSQEVISILNTLCWDKKNTVFIVSGRGRDNLSQWFSPCRKLGLAAEHGYFLRWXQDKEWETCGQSSDFGWKQIAEPVMKLYTETTDGSSIESKESALVWQYGDADPGFGSSQAKEMLDHLESVLANEPVAVKSGHFIVEVKPQGVSKGLAAEKIFTTMTENGKQADFLLCIGDDRSDEDMFEIIGSAMSTNILSANTSLFACTVGQKPSKAKYYLDDASEVICMLESLAEASDSGPSSEEETQFVLHEANLEEVEEEVNLKSLLEEILRPTVLLSQF

SEQ ID NO: 654 - protein, 306 aa, Triticum aestivum
  misc_feature (88)..(88): Xaa can be any naturally occurring amino acid
  misc_feature (156)..(156): Xaa can be any naturally occurring amino acid
  misc_feature (165)..(165): Xaa can be any naturally occurring amino acid
  misc_feature (178)..(178): Xaa can be any naturally occurring amino acid
  misc_feature (211)..(211): Xaa can be any naturally occurring amino acid
  misc_feature (222)..(222): Xaa can be any naturally occurring amino acid
  misc_feature (238)..(238): Xaa can be any naturally occurring amino acid
  misc_feature (240)..(240): Xaa can be any naturally occurring amino acid
  misc_feature (250)..(251): Xaa can be any naturally occurring amino acid
HLVNYRKVCTKKQAGTGPEFPGYRRPTRPRASELQKEGKRIIFTNVGNPHALGQKPLTFPRQVVALCQAPFLLDDPNVGLIFPADAIXARAKHYLSLAPGGLGAYSDSRGIPGVRQEVAEFIQRRDGYPSDPELIYLTDGASKGVMQMLNAIIRNXERDGILVPXVPQYPLYSAAISXFGWFSLSRLLFGREEANWGTLIFVQYPGNPVAXARSKRGTTVRXTMGDNKPQETLLGQCXKXANIKELLDFXXYQGNLVLLADEVYQQNVYPDERPFISAGKVMFDRAPSSKQGKSTGLTLQTFQGMG

SEQ ID NO: 655 - protein, 441 aa, Arabidopsis thaliana
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGRR

SEQ ID NO: 656 - protein, 172 aa, Vibrio salmonicida LFI1238
MKIGLFYGSSTCYTEMASEKIRSTIGEDIVDIFNIKDTSASAMNDYDLLILGISTWDFGEIQEDWLAVWEELDGLSLKGKTIALFGLGDQGGYGEWFLDAMGLLHDELKATDATFIGYWKNEGYVFDASKALTEDESHFVGLALDEDSQYDKSDERIEQWCEQILVEYHDSL

SEQ ID NO: 657 - protein, 403 aa, marine gamma proteobacterium HTCC2143
MKPIKQSEKLANVCYDIRGPVLAEANRLEEEGHRILKLNIGNPAAFGFDAPDEIIQDVIRLLPTSQGYCESKGLYSARKAVMQHYQQRGVLDVDIDDIYLGNGVSELITMSMQALLNNDDEVLIPAPDYPLWTASVSLSGGTPVHYICDEEADWFPDIADIRSKISSKTRAIVVINPNNPTGAVYSKELLQEIVKLAEEHSLVIFADEIYDKILYDEAQHIPLATLADNVLCVTFNGLSKAYRLAGFRSGWMMLTGAKSHAQGYIEGLTILASMRLCANVPAQHAIQTCLGGYQSINDLVLPGGRLLKQRNAAIELLNQIPGVSCVKPKGAIYMFPKLDVKKFAIQNDEKLVLDFLRHEKILLVQGTAFNWKQPDHLRVVFLPQVDDLTRAMERFAAYLSRIG

SEQ ID NO: 658 - protein, 292 aa, Picea sitchensis
MSLQSVRLSSAGLVFLLSFVAYFAAISNAAIHNYTFIIEKKTVTRLCKQRIIATVNGQLPGPTIHVSNGDTVNIKAYNRAGYNATLHWHGVEQIRTGWADGPAYITQCPIPPGGHYTYRFTISGQEGTVWWHAHVSWLRATVHGAFVIYPKKGKPYPFPKPLAEIPLVIGEWWNNNPVAVIDEAVLTGGAPNISDTFTINGQPGDLLPCSSSETFRFAVKQGETYLLRLVNAALNSGHFFKITPRIYCCSCGCLLHQAIQNRCSRHLCRPDYRCSYHGQPACGQILYGRPTI

SEQ ID NO: 659 - protein, 384 aa, Staphylococcus aureus subsp. aureus COL
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPLFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 660 - protein, 518 aa, Thiobacillus denitrificans ATCC 25259
MAASLVIVYHRQPYEEHVEGGKTVFRENASPNGIVPALKGFIGQTERASWIAWKKSPAGKPVRFERRITVEDSYGSYEVVRLPLSAEQISQFYHVTSKEALWPILNSFPSLYSTENCDWAAFREVNRLFAEAACEEAAPGAVVWVHDYNLWLVPKFVRALRPDVRIAFFHHTPFPAADVFNILPWRDEIVDSLLDCDLVGFHVPRYARNFVSVVQSLRPVDALVERDVPPDLRATGTALSEPVTPVVLHSGKRRVQIDAFPIGTHASLIRETVQQPERLAQVAQIRHDIPQEKIIVSIGRVDYAKGTREMLLAYERLLQRRPELHGRIKLLVTAVAAADGMRVYKRAQQSIEQLAGRINGRIGTLAWQPILLSTTPMPFAETLCYYRAADICWITPLRDGLNLVAKEFIAAHVNESGVLVLSEFAGAAVELQDAVLVNPYSLVQMDAAIDRALDMPAAEQRARMQRMDALMDRYDIGHWTRHVLELFAQLPARAQADADPAPQRARRAGRAPAAVPVH

SEQ ID NO: 661 - protein, 503 aa, Coprinopsis cinerea okayama7#130
MLSNLLPLAILAVSLRPLIVPVTAQAIPPVATMTVSNINASPDGFTRPVVAVNGQHPPPPILANKGDDFQITVVNNLDDPTMLRQTSVHWHGIFVHKAAWADGPDGVTQCPIAQSGDSFTYSFDAGNEAGTFWYHSHYGTQYCDGLRGPLVIYDDNDPYKNLYHLPTPSIAGIALSDATLINGKGRRPGGPLTDIEIVNVQPGTRYRFRLISMACEPTYKFSIDGHNMTIIEADGQLTEPHTVQEITIFTGQRYSFILEANQPVGNYWIRAIPNLGARNLPDFSSGGINSAILRYAGARPRNPTTRAPRNPVVLKEANLRTLLNPGAPGGSGPADENIVFNLALNAEETGFVMNGVAWANPDIPVMVQLMNGVPAEDIIPQGAYRTLPRNSVVEVSIPGFEIAGPHAFDVVRSAGSDTYNYVNPVRRDVVDIGGAGDNVTIRFRTDNPGPWFFHCGLAMVFLEAPGDIASNSPPPPSWDALCPKFKSLPANATSIQIVPTPTP

SEQ ID NO: 662 - protein, 395 aa, Lentinus tigrinus
HWHGFFQKGTNWADGPAFVNQCPISSGHSFLYDFRVPDQAGTFWYHSHHSTQYCDGLRGPIVVYDPKDPQKHLYDVDNESTVITLSDWYHVAAKLGPRFPPGSDLTLINGLGRSGSTPTADLAVITVTHGKRYRFRLISMSCDPNYVFSIDNHDLTIIETDAINTKPHVVDSIQIFAAQRYSFVLNANQNVSNYWVRANPNFGTTGFADGVNSAILRYDGAPVAEPAPSDPPASVKPLVETDLHPLASMPVPGKPVAGGVDKAINLDFNFNGTNFFINNASFIPPTAPVLLQILSGAHLAQDLLPSGSVIPLPAHKTIEISMPATTHAPGAPHPFHLHGHAFAVVRSAGSTSYNYKDPIWRDVVNTGTPQAGDNVTIRFHTDNPGPWFLHCHIDF

SEQ ID NO: 663 - protein, 394 aa, Lentinus tigrinus
HWHGFFQKGTNWADGPAFVNQCPISTGNSFLYDFQTPGQAGTFWYHSHLSTQYCDGLRGPMVVYDDADPHASLYDVDDDSTVITLADWYHTAARLGARFPIGSDSTLINGLGRAAGGDADAALSVISVTSGKRYRFRLINISCDPNFTFTIQGHTMTVIEADAVSVQPYEVDSIQIYAGQRYSFVLTADQAVDNYWIQAIPNVGTITTDGGVNSAILRYDGADEVEPTAATVTGSNPLAETSLVPLENLAAPGTAAVGGVDYALNLDFSFDGTDFAINGATFTSPSVPVLLQIMSGASDVADLLPSGSIYALPSNSTIELSFPITATNAPGAPHPFHLHGHTFHVVRSAGSTDYNYVNPVQRDTVSTGTAGDNVTIRFTTNNPGPWFLHCHIVF

SEQ ID NO: 664 - protein, 175 aa, Pseudoalteromonas sp. SM9913
MASVGIFFGSDTGNTEHVAKMIQKELGKKLVAVHDIAKSSKEEIAEFDLILFGIPTWYYGEAQCDWDDFFPELEEVSFEGKLVAIFGCGDQEDYAEYFLDAMGMINDIVTERGAIVVGHWPTDSYDFEASKGMADDKHFVGLGIDEDRQPELTEQRVKQWCAQVYDEMCLSELAD

SEQ ID NO: 665 - protein, 170 aa, Synechocystis sp. PCC 6803
MTKIGLFYGTQTGNTETIAELIQKEMGGDSVVDMMDISQADVDDFRQYSCLIIGCPTWNVGELQSDWEGFYDQLDEIDFNGKKVAYFGAGDQVGYADNFQDAMGILEEKISGLGGKTVGFWPTAGYDFDESKAVKNGKFVGLALDEDNQPELTELRVKTWVSEIKPILQS

SEQ ID NO: 666 - protein, 394 aa, Lentinus tigrinus
HWHGFFQKGTNWADGPAFVNQCPISTGNSFLYDFQTPGQAGTFWYHSHLSTQYCDGLRGPMVVYDDADPHASLYDVDDDSTVITLADWYHTAARLGARFPIGSDSTLINGLGRAAGGDADAALSVISVTSGKRYRFRLINISCDPNFTFTIQGHTMTVIEADAVSVQPYEVDSIQIYAGQRYSFVLTADQAVDNYWIQAIPNVGTITTDGGVNSAILRYDGADEVEPTAATVTGSNPLAETSLVPLENLAAPGTAAVGGVDYALNLDFSFDGTDFAINGATFTSPSVPVLLQIMSGASDVADLLPSGSIYALPSNSTIELSFPITATNAPGAPHPFHLHGHTFHVVRSAGSTDYNYVNPVQRDTVSTGTAGDNVTIRFTTNNPGPWFLHCHIDF

SEQ ID NO: 667 - protein, 398 aa, Pyrococcus abyssi GE5
MVRASKRALSIEYAIRDVVLPARELEKKGIKVIRLNIGDPVKFDFQPPEHMKEAYCKAIKEGHNYYGDSEGLMELREAIVEREKKKNGVNITPDDVRVTAAVTEALQMIFGALLDPGDEILIPGPSYPPYTGLVKFYGGVPVEYRTIEEEGWQPDIDDLRKKITERTKAIAVINPNNPTGALYDKKTLEEIINIAGEHDIPVLSDEIYDLMTYEGKHISPASLTKDVPVIVMNGLSKVYFATGWRLGYMYFVDPEGKLSEVREAIDKLARIRLCPNTPAQFAAIAGLRGPMDYLEEYMKKLKERRDYIYKRLNEIPGISTTKPQGAFYIFPRIEEGPWKDDKEFVLDVLHNAHVLFVHGSGFGEYGRGHFRAVFLPPVEVLEEAMNRFEKFMREKLSS

SEQ ID NO: 668 - protein, 85 aa, Carica papaya
SPKYNVCRQGVSGAESSESSGPKKSMLVVSEFIGCSPSLSGAIRVNPWNVESTAEAMNEAISMADAEKQLRHEKHYRYVSTLLSQ

SEQ ID NO: 669 - protein, 403 aa, Azotobacter vinelandii
MQVSKSNKLANVCYDIRGPVLKHAKRLEEEGHRILKLNIGNPAPFGFEAPEEILQDVIRNLPTAQGYSDSKGLFSARKAVMQYYQQKKVEGIGIEDIYLGNGVSELIVMVLQALLNNGDEVLIPAPDYPLWTAATSLAGGKAVHYLCDEQSNWYPDIADIEAKITRNTKALLLINPNNPTGAVYPREVLERIVEVARQHNLVIFSDEIYDKILYDDAQHISTASLAPDVLCLTFNGLSKAYRVAGFRSGWVAISGPRHKAQSYIEGLDILANMRLCANVPAQHAIQTALGGYQSINDLILPGGRLLEQRNRTWELLNDIPGVSCVKPMGALYAFPKIDPKVCPIHNDEKFVLDLLLQEKLLIVQGTAFNWPWPDHFRVVTLPRVDDLEQAIGRIGNFLKTYRQ

SEQ ID NO: 670 - protein, 578 aa, Triticum aestivum
  misc_feature (205)..(205): Xaa can be any naturally occurring amino acid
  misc_feature (219)..(219): Xaa can be any naturally occurring amino acid
MRRFLTDRARRAVAASLRGATRAAAPSPAPAPAAALSRPSPSAPSAMAAYMARAMSTSAAGTPPVSLDTINPKVLEFKYAVRGEIVTHAQNLEQELHKNPESLPFDEILYCNIGNPHSLGQQPVTFFREVLSLCDHPALLDKSETHALYSSDAIERAWQILEKIPGRATGAYSHSQGVKGLRDEIAAGIAARDGFHASGDKSRLXTVRNARDIVDPRVXNIFLTDGASPAVHMMMQLLIRSEKDGILCPLPQYPLYSASIALHGGSFVPYFLDEEAGWGLEVDELKKQVDEARSKGITVRALVVINPGNPTGQVLAEENQKKIVEFCKNEGLVLLADEVYQENIYVEDKQFHSFKKIARSMGYTDDDLPLVSFQSVSKGYYGECGKRGGYMEVTGFNADVREQIYKVASVNLCSNISGQILSSLIMNPPKVGDESYESFMVERDGIISSLARRAKALEEAFNSLEGITCNKAEGAMYLFPRLHLPQKAIGAAQAAGAAPDAYYALRLLQATGIVVVPGSGFGQAPGTYHFRCTILPQEDKIPAIISRFKEFHEKFMDEFRDVSRDEAPTGTTIESGGD

SEQ ID NO: 671 - protein, 477 aa, Vitis labrusca
MSHKGLDYETLNENVKKVQYAVRGELYLRASELQKEGKKIIFTNVGNPHALGQKPLTFPRQVVALCQAPFLLDDPNVGLVFPADAIARAKHYLSLTTGGLGAYSDSRGLPGIRKEVAEFIGRRDGYPSDPELIFLTDGASKGVMQILNTIIRGERDGILVPVPQYPLYSAAISLYGGSLVPYYLEETANWGLDVNNLHSSVAAARSKGITVRAMVIINPGNPTGQCLSEANLKEILHFCNQENLVLLGDEVYQQNIYQDERPFISARKALMDMGPPISKELQLVSFHTVSKGYWGECGQRGGYFEMTNIPPQTVDEIYKVASISLSPNVPGQIFLGVMVNPPTPGDISYLQFMRESKGILESLRRRAQIMTDGFNSCRNVVCNFTEGAMYSFPQIRLPPKAIEAAKKAGKVADVFYCLKLLEATGISTVPGSGFGQKEGVFHLRTTILPAEEDMPAIMESFKKFNDEFMEQYEDHRG

SEQ ID NO: 672 - protein, 471 aa, Rhizobium leguminosarum bv. trifolii
MSRLVVVSNRVPMPAKDGSAAAGGLAVALQAALQERGGIWMGWSGESSGDREPGPLSQLQKGNITYALTDLTDTDVEEYYRGFANRVLWPICHYRLDLAEYGRKEMAGYFRVNRFFAHRLAPMIEPDDIIWVHDYHLIPLAAELRQMGLKNRIGFFLHIPWPPADILVTMPVHEEIMRGLSHYDLVGFQTDYDLQNFAGYLRREGIGDDLGNGLFDSHGRIFKAGAYPIGIETAGFAEFAERAANHIMVQKTRRSVEGRDMIIGVDRLDYSKGIIQRLEAFETFLTSNPAYQNKVTYLQVTPKSRSEVPEYEHMQKMVAEQAGRVNGAIGTVDWVPIRYVNRSISRNVLAGLYRLATIGLVTPLRDGMNLVAKEYVAAQDPDRPGVLVLSRFAGAARELKGALLVNPYDVEGTANAIAKGLAMSLEERRNRWSMMMEHLLTHDVSLWCENFLGDLVLAPEPRLERDSRTGS

SEQ ID NO: 673 - protein, 484 aa, Vitis vinifera
MSHKGLDYETLNENVKKVQYAVRGELYLRASELQKEGKKIIFTNVGNPHALGQKPLTFPRQVVALCQAPFLLDDPNVGLVFPADAIARAKHYLSLTSGGLGAYSDSRGLPGIRKEVAEFIGRRDGYPSDPELIFLTDGASKGVMQILNTIIRGERDGILVPVPQYPLYSAAISLFGGSLVPYYLEETANWGLDVNNLHSSVAAARSKGITVRAMVIINPGNPTGQCLSEANLKEILHFCYQENLVLLGDEVYQQNIYQDERPFISARKVLMDMGPPISKELQLVSFHTVSKGYWGECGQRGGYFEMTNIPPQTVDEIYKVASISLSPNVPGQIFLGVMVNPPTPGDISYLQFMRESKGILESLRRRAQIMTDGFNSCRNVVCNFTEGAMYSFPQIRLPPKAIEAAKKAGKVADVFYCLKLLEATGISTVPGSGFGQKEGVFHLRTTILPAEEEMPAIMESFKKFNDEFMEQYEDHRGYSRMKNH

SEQ ID NO: 674 - protein, 520 aa, Trametes pubescens
MSRFQSLLAFVVASLAAVAHAGIGPVADLTISNAAVSPDGFSRQAVVVNGGTPGPLITGNKGDNFQLNVIDNLTNHTMLKSTSIHWHGFFQKGTNWADGPAFINQCPISSGNSFLYNFQVPDQAGTFWYHSHLSTQYCDGLRGPFVVYDPNDPSADLYDVDNDDTVITLVDWYHVAAKLGPAFPLGADATLINGKGRSPSTTTADLAVISVTAGKRYRFRLVSLSCDPNYVFSIDGHNMTIIETDSINTQPLVVDSIQIFAAQRYSFVLEANQAVDNYWIRANPNFGNVGFTGGINSAILRYDGAAAIEPTTTQTTSTQPLNEVNLHPLVATAVPGSPVAGGVDLAINMAFNFNGTNFFINGASFTPPTVPVLLQIISGAQNAQDLLPSGSVYSLPSNADIEISFPATTAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDPSDQ

SEQ ID NO: 675 - protein, 289 aa, Saccharomyces cerevisiae
DPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 676 - protein, 673 aa, Oryza sativa Japonica Group
MAAAMEMAANPGGSGTCSDALFRELWHACAGPLVTVPKRGERVYYFPQGHMEQLEASTNQQLDQYLPMFNLPSKILCSVVNVELRAEADSDEVYAQIMLQPEADQSELTSLDPELQDLEKCTAHSFCKTLTASDTSTHGGFSVLRRHAEECLPQLDMSQNPPCQELVAKDLHGTEWHFRHIFRGQPRRHLLTTGWSVFVSSKRLVAGDAFIFLRGESGELRVGVRRLMRQVNNMPSSVISSHSMHLGVLATASHAISTGTLFSVFYKPRTSRSEFVVSVNKYLEAKKQNLSVGMRFKMRFEGDEAPERRFSGTIIGIGSVPAMSKSPWADSDWKSLKVQWDEPSAIVRPDRVSPWELEPLDASNPQPPQPPLRNKRARPPASPSVVAELPPSFGLWKPPSEAAQTLSFSEPQRAREIFPSIPASIFSASSHVEFNSKNEPSILSNQFYWSMRDSKTDSFSASTNKTRVERKQEPTTMGCRLFGIEISSAVEEALPAATVSGVGYDQTVLSVDVDSDQISQPSNGNKSDAPGTSSERSPLESQSRQVRSCTKVIMQGMAVGRAVDLTKLNGYGDLRSKLEEMFDIQGDLCPTLKRWQVVYTDDEDDMMLVGDDPWDEFCSMVKRIYIYSYEEAKLLAPKSKLPVIGDTIKLSSMNSSHESVDLDNHASVTNRDC

SEQ ID NO: 677 - protein, 526 aa, Trametes pubescens
MGKFHSFVNLALSLSLSGRVFGAIGPVTDLTISNADVTPDGITRAAVLANSVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSINGHNMTIIEVDGVNHESLDVDSIQIFAGQRYSFILNANQTIDNYWIRAIPNVGTTDTTGGVNSAILRYDTAEEIEPTTNATTSVIPLAETDLVPLDNPAAPGDPQVGGVDLAMSLDFSFNGSNFFINNETFVPPTVPVLLQILSGAQDAASLLPNGSVYTLPANSTIEISFPIITTDGASNAPGAPHPFHLHGHTFSVVRSAGSSTFNYANPVRRDTVSTGNSGDNVTIRFTTDNPGPWFLHCHIDFHLEAGFAIVFAEDTADTASVNPVPTAWSDLCPTYDALDSSDL

SEQ ID NO: 678 - protein, 176 aa, Cyanothece sp. ATCC 51142
MIMAKIGIFYGSTSGITEEIAMTLRQKLGEEQCDIYSMEEDFDEYDQLLDYDYLLLGCSTWGAGDVQNDWRDPLFEMELEKPDFTGKTIALFGAGDQVDHGNEFVSALGKMYNHFQKLGATLVGEFPNEGYTFQYSSALLNDKFVGLPIDEVNQSDQTETRINQWVESIRPIFLNN

SEQ ID NO: 679 - protein, 405 aa, Alteromonadales bacterium TW-7
MSDIKKSHKLEGVCYDIRGPVLAQAKKMEDDGQKVLKLNIGNPAAFGFDMPEDMHRDIIRNLYSAQGYCDSKGLYSARVAVYQHYQQRGLNNLDVDNIYIGNGVSELIQMITQALLNNDDEVLIPAPDYPLWTASVKLAGGNPVHYLCDEEQDWFPDIDDIKSKITSKTKALVLINPNNPTGAVYSDDLLKQLIDIAREHKLLLLSDEIYEKILYDGVSHTSIASLCDDVPMITFNGLAKTYRAAGLRMGWMVLSGKTSAMDDLSKGLDILSSMRLCANVPAQYAIQQALGGVQSIDNLINPGGRLYEQRDIAWRGLNAIEGISCKKPKGALYAFAKVDTAHFNVKNDEQMMFDLLKAEKILLVHGRAFNWPEPDHFRLVFLPNKDDLTDAMQKMQRFFKDYRQL

SEQ ID NO: 680 - protein, 517 aa, Glycine max
MTQQPPWQELVATDLHGNEWHFRHIFRGQPRRHLLTTGWSVFVSSKKLVAGDAFIFLRGENGELRVGVRRLMRQQSNMPSSVISSHSMHLGVLATASHAIATGTLFSVFYKPRTSRSEFIVSVNKYLEARSHKLSVGMRFKMRFEGDEVPERRFSGTIVGVGDNKSSVWADSEWRSLKVQWDEPSSILRPDRVSPWELEPLVSTPPTNPQPSQRNKRSRPPILPSTMPDSSLQGVWKSPVESAPFSYCDHQHGRDVYPSTNFNSTATGFLGFGGNCYASNKSIYWSSRMENSTESFSPVALKEFGEKRQGTANGCRLFRIQLHDNSNSNEESLPMVTLSGRMGDDGPLPSLDAESDQHSEPSNVNRSDIPSVSCDAEKSCLRSPQESQSRQIRSCTKVHMQGMAVGRAVDLTRFDGYEDLLRKLEEMFDITGELCGSTKKWQVVYTDNEDDMMMVGDDPWLEFCSIVRKIFIYTAEEVRKLSPKIGLPISEEVKPSKMDSEAVANPEDQSSIVGPGC

SEQ ID NO: 681 - protein, 412 aa, Burkholderia cenocepacia J2315
MKPIQKSNKLLNVCYDIRGPVLEHAKRLEEEGHRIIKLNIGNLAPFGFDAPDEIIQDMIRNLPASSGYSDSKGVFSARKAVMHYTQEKGVVGVGLDDIYIGNGASELIVMATQALLNDGDEVLLPAPDYPLWTAAVSLSGGTPVHYVCDEQNAWMPDLDDIRRKITPNTKAIVVINPNNPTGALYSDELLLELLEIARQHGLIVFADEVYDKIVYDGLEHTALGALSEDVITVTFNSLSKSYRSCGYRAGWMAVSGLGGDNRRRAKDYLEGLGILSSMRLCANVPGQFAIQTALGGYQSINELIVPSGRLYKQRELAYDMLTSIPGVTCVKPQAALYMFPRLDPKLYPIQNDQQFILDLLLEERVLLVQGTGFNWTTPDHFRVVFLPNLDDLTDSINRIARFLDGYRKRHSV

SEQ ID NO: 682 - protein, 540 aa, Arabidopsis thaliana; identical to SEQ ID NO: 102

SEQ ID NO: 683 - protein, 175 aa, Shewanella sp. MR-4
MATVGLFFGSDTGNTEAVAKMIQKKLGKKMVEVKDIAKSTKEQIAEYDLLLFGIPTWYYGEAQCDWDDFFPELEQIDFTDKLVAIFGCGDQEDYAEYFLDAMGMVGDIVQARGGIIIGHWPTAGYNFEASKGLVDDDHFIGLGIDEDRQPELTEERVDAWVKQIYEEMCLAEFED

SEQ ID NO: 684 - protein, 518 aa, Bifidobacterium longum DJO10A
MSVSVFAERLRNAMNSRGLKQVDLVHAAEHRGVKMGKSHISQYVAGKTMPREDVLEFLASELDVDTNWLRGEESTTQLNSDASNSVTDGEHAATPLAMGAAKPQTDSEIPVGRRRTFGKSHKLDNVLYDVRGPVADEAMRMEANGTHILKLNIGNPAPFGFRTPDEVVYDMAHQLTDTEGYSPSKGLFSARKAIMQYAQLKNIPNVTIDDIYTGNGVSELINLSMSALLDTGDEVLVPSPDYPLWTACVNLAGGTAVHYLCDEQSEWYPDIDDIRSKITSNTKAIVIINPNNPTGALYPKEVLQQIVDIAREHQLIIFSDEIYDRLVMDGLQHISIASMAPDLFCVTFSGLSKSHMIAGYRIGWMILSGNKRIAKDYIEGLNMLANMRMCSNVPAQSVVQTALGGHQSVNDYIVPGGRVHDQRDLVYDMLNQIPGITAVKPKAAFYIFPKIDVKRFNIHSDEQFALDLLHDKHILISHGGAFNWHRPDHFRVVYLPRMGMLRETMGEISDFFSYYWQS

SEQ ID NO: 685 - protein, 404 aa, Shewanella sp. MR-4
MRPIIKSNKLDTVCYDIRGPVHKEARRLEDEGHRILKLNIGNPAPFGFEAPEEIVRDVILNLPSAQGYCESKGLFSARKAIVQHYQAQGIKGVDIEDVYIGNGVSELIMMAMQGLLNTDDEVLIPSPDYPLWTAAANLAGGKAVHYRCDEEADWFPDLDDIKSKISSRTRGIVLINPNNPTGAVYSKELLLQVIELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLRDKKILLVHGSAFNWPEPDHLRVVFLPYKEDLTKALTEFGNFLETYKQ

SEQ ID NO: 686 - protein, 480 aa, Physcomitrella patens subsp. patens
MASGKVMDPDNLNENVKKTVYAVRGELYLRASELQKEGKKIIFTNVGNPHALGQKPLTFPRQVMALCQAPFLMDDPHVGLLFPADAIAKAKHYLAMTSGGVGAYSDSRGLPGVRQEVANFILQRDGYPSDPENIFLTDGASKGVAQVLNALIRDEKDGVLVPIPQYPLYSATIQLLGGTLVPYYLAEEDNWGLNTNDLRKSVTEARRKGICVRGLVFINPGNPTGQCLTEKNLRELIEFCIKEKIVLMADEVYQQNVYQDERPFISARKVLMGMGPPVSEALELVSFHTVSKGFLGECGQRGGYFEMTNIHPKTVDELYKVSSIALSPNVTGQIMMGLMVSPPKPGDISYPLYKAESEAISLSLRKRAHIMTDGFNACENIVCNFTEGAMYSFPQVKLPQAAIAAAKKAGKAPDVFYCLRLLEATGISTVPGSGFGQKEGTFHVRTTILPSERDMPGIMESFKKFNADFMAQHSDTKSKL

SEQ ID NO: 687 - protein, 486 aa, Capsicum chinense
MGFECAKNNAILSKLATNEEHGENSPYFDGWKAYDNDPFHPLKNPNGVIQMGLAENQLCFDLIEEWIKRNPKASICSNEGIKSFKAIANFQDYHGLPEFRRAIAKFMEKTRGGRVRFDPERVVMAGGATGANESIIFCLADPGDAFLVPSPYYPAFNRDLRWRTGVQLIPIHCESSNNFQITAKAVKEAYENAQKSNIKVKGLILTNPSNPLGTTLDKHTLKSLLNFTNQHNLHLVCDEIYAATVFDMPQFVSIAEILEDNEMSHCNKDLVHIVYSLSKDMGLPGFRIGIIYSFNDAVVSCARKMSSFGLVSTQTQHFLAAMLNDEKFVVNYLAESARRLDNRHKHFTDGLEEVGITCLKNNAGLFCWMDLRKLLRDSTFDSEMSLWRVIINDVKLNVSPGSSFDCQEPGWFRVCFANMDDGTVDIALARIRRFVGVKKSGDESNAMEKKQQWKKNNLRLSFSKRMYDESVLSPLSSPIPHSPLVR

SEQ ID NO: 688 - protein, 904 aa, Candida albicans SC5314
MESSVVDSKKPNEGMGLPGFSRSQVNLANSTPNLARVAKPLAPPPLNRGRSSFSKALFTFHGNSSATSLLSEDGTADSSPVILPSSLEDDFDQNFHDMVHGKSRLAPFGGFSRPGVESQFLSEKNIFDVAPWTIVPPDNGNGSLTKAVNVSIDSGIMDKAKWVGIVAMPSDDVSLRVKSEISQKLSADYDCEAVFPDDVTFEGHYKSFCKQILWPTLHYQIPDDPKSKAFEDHSWGHYVLMNQLIADKIVETYNDVNDEETTVWIHDYHLLLVPKMVRDKLPNAKIGFFLHVSFPSSEVFRCFAQRNQLLEGMLGANSIGFQTNEYVRHFLQTCNRLLLADTSESGVNYQGNFTVTSTIPVGIDAYSVRENVHTEQVTEWRSLIKERWKDQHLIVSRDKLDKLRGIKQKLLAYEMFLTDNPEYIESTVLIQICIGSAQDPDYESEIMKIVSRINSMPENISVTQPVVLLQRDIGFDQYLALLCEADVFVVSSMREGLNLTCHEFITATEDKKSPLMLSEFTGSSNLLSCKGEGAILINPWDIKKFSETIKTSLTMPTSEKELRWHNCNQIVLTHDSKHWVTSCLNSIVNSWKIDHKKSGNLVPFTKNAFKDWCSVNGKRLIILALEISSAVSNSRGNSAGSTSGKVNVIDPSGLVRLLSDLVESQDTFVYLLSYLQRSDLDIMFKRYPQIGLIAENGNFVKLIGAKNWISLADKDELNSWMPEIVKLVESKVERLPGSFCEALDATVRFHAGKSFSEDRERSLDTMGETIQHINTLFEHNGVHATLVRNSVIVQKDQISLKAIRLVLSCHNSNLDQKYVVTHINEFQQPMKDDIPSNDHEVAAVLYSGGLTSIDEANYEYVNSLKKDIGNTLTVTLISSSNEETKTAATYGVRGINELLCILNS

SEQ ID NO: 689 - protein, 129 aa, Oryza sativa
  misc_feature (13)..(13): Xaa can be any naturally occurring amino acid
  misc_feature (23)..(23): Xaa can be any naturally occurring amino acid
  misc_feature (33)..(33): Xaa can be any naturally occurring amino acid
  misc_feature (46)..(46): Xaa can be any naturally occurring amino acid
  misc_feature (58)..(58): Xaa can be any naturally occurring amino acid
  misc_feature (66)..(66): Xaa can be any naturally occurring amino acid
  misc_feature (78)..(78): Xaa can be any naturally occurring amino acid
  misc_feature (95)..(95): Xaa can be any naturally occurring amino acid
QVYLDLLRRRARXGQMGFNSCRXNVVSNFTEGXAMYSVPPIRLPPXKAIDAAKRAGKXAADVFYCXLKLLEATGISTXVPGSGFGQKEGVFHPEXTAILPAEEDMPAIMTSFKKFNDTFMDQYDGYSRM

SEQ ID NO: 690 - protein, 484 aa, Rubrobacter xylanophilus DSM 9941
MAHSGGVVIVSNRAPVTFSRSGSGERTHSRGAGGLVTALNAVSRRAEGAVWIASAASDEDVRVARESEGPCEVDDLRLVLVEHDAGAYDLMYNRLANPLLWFVQHGLYDLPYAPELGEETLRAWEEGYLPVNRSFARAAAEAISGAEEPVVLLHDYHLYMVPELLREEVGEGPLISFFVHIPWPEPDLWRVLPSYIREGALRSLLRSDIVAFHTRRYARNFMAAASEILGAEADPARGTLRRGGREVWVRSYPISIDPAEFEEVAESPEVRREEEYVRNLPGALLVRVDRTDLSKNIVRGFRAYGRMLELHPEMRGRVTFFAQLQPSRGDIPEYAAYAEAIRRSAEEVNEAHGTPSWRPVELSMQDNFPRSVAAYKNYDALLVNAVRDGMNLVAKEAAVVNRRDGALILSENAGAHEELGEHALTVNPFDLDDQAAAIHRALTMPPEERARRARALRETVLSNTIEDWAAAQMRDIAARRAASS

SEQ ID NO: 691 - protein, 597 aa, Magnaporthe grisea 70-15
MVQSVIFGLLLAALPVQTFNVLPGYQKLSSVRNGALSVLGSHNQKRQNFQNGPCAGNTATTRSTWCSYNIDYDWYDVVPTTGVTREYWFVLSDNRTISPDGVPRYAQTINGTMPGPTLFANWGDNVVVHLTNNLTRSVNGTSLHFHGMRQYYTVQNDGVASITQCPIPPGSSMTYKWRATQYGTSWYHSHFGLQAWAGMYGGIVINGPASENYDHDLGALFLSDWSHETPDALFHTAQTTGPPILSNGLINGTNVYGEDGSGNQTGSRFTQRVTAGESYRFRLINSAIDSHFRFSIDNHTLTVIAADLVPIESYTTKMVSIGIGQRYDVLVTADQGSTAGAESFWMRAIPQVNCTKARSPTNVRGILHYGERPSTPRSTGYAYTDSCQDEDAKRLVPVVPKDVDSPTWTHFDLASWNRTSDNLLRWYLNGTSMSVDWSNPTLAQIHDNATEYKRSHAVAELDEPDSWAYVAVETNASASHPVHLHGFDFYILAQGSGRYDAHDPSALNLVNPPRRDTAMLPAWGYVVLAFKTDNPGAWLMHCHIGWHTSEGFAMQFVVRKRDLLRNKMIDYASLNGTCAAWKRHVAAGGIVLADSGV

SEQ ID NO: 692 - protein, 531 aa, Pleurotus sapidus
MFPGARILATLTLALHLLRGTHAAIGPIDDMYIVNEDVSPDGFTRSAVVARSVPATGPAPATVSIPGVLVQGNKGDNFQLNVVNQLSDTTMLKTTSIHWHGFFQFGTSWADGPAFVTQCPIASGDSFLYNFNVPDQAGTFWYHSHLSTQYCDGLRGPFVVYDPSDPHLSLYDIDNADTVITLEDWYHVVAPQNAVLPTPDSTLINGKSRYAGGPTSPLAIINVESTKRYRFRLVSMSCDPNFMFSIDGHSLQVIEADAVNIVPITVDSIQIFAGQRYSFVLTADQTVGNYWIRANPNLGSTGFAGGINSAILRYAGATEDDPTTTSSTSTPLLETNLVPLENPGAPGPAVPGGADININPAMAFDFTNFELTINGAPFHAPTAPVLLQILSGATTAASLLPSGSIYELEANKVVEISIPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDDLCPIYDALSDSDKGGIV

SEQ ID NO: 693 - protein, 603 aa, Magnaporthe grisea 70-15
MPSMLLTWLLLLLGSCLAAEFRVHDKTFKPDYVLVATAQNITINCQTRYSIVFNGTSPGPLLTFHENQTTWVRVYNRIKDQNVTVHWHGLSQRTAPFSDGTPLVSQWPVAPDNFFDYEIRPDIGSAGTYFYHSHVEFQAVTAHGALIVEDAVKPPYEYDEDVVVGLGEYYPKTDRQILDGLLAKPFRWSGEPEAILFAGRSGNKSFTEASHDSCKPDLIKVQPDKTYRVRFIGGTAMSLVVMAFEGHDMTIIEADGSYTKPVKTDRMQVGSGQRYSILLRTKSVQEVASTNKTSYWIQYETRGRPTNVTGWALLQYEMPGQPEAMLPATLPSKPVATIPDDPSTWMEFTLQPLQDSVREQFPKLSEVTRTIYIDVKQVVVDGGVVNGTVKGSIEWAQNSLVWQEDSQAAKNRPPVLVGILTTGMSPSIEAALANQNWDPTTQTFPAAVGETLDIVWQGNSGELGGWDVHPMHAHGTHFWDLGSGNGTYDAPAVDAKYYADGNYVPAVRDTTMLYRYAAKGEKNHTAGWRAWRVRVTEDDIGAWVMHCHVLQHMMMGMQTVWVLGTAAEILQKFPTSPYVNGYLTFGGDAYGNATFDPLVLQHF

SEQ ID NO: 694 - protein, 559 aa, Phanerochaete chrysosporium
MLFALLALGAAIGVGAAPSSGPPVVQVPSMDNFVLGSGVAGQPPQVRHYEFVVEEMLGAPDGVTKPMLVVNGLFPGPTIEVNQYDRLVVRVINRIQNATTIHWHGIPQNGTAYYDGTAGITECGIPPGQSLTYDFTFGDFSGTTWWHSHYDTQYTDGVTGALIVHPTFPDPPGFPTWDEELVIELTDVYHTFSTILNAQYLSPSGPIGGSAGDEPVPDSGALNGLGQYHGLGNYFNFTLQPNKTYRLRLIHTGSLADIRFSVDNHPLTVIEADGTLTEPTVVAGLTLAVAQRYSVLLTTNQTNGSYWMRTLQQTDMFTYKLPGQNPDNRGIISYGTGTGPTLPPAKEDPGATLGGMQLNDLDPYTLPPAVPEAVPDNTKFYQVSFEFDNLPSGASRAYMNGTSWDPLPKTNILLEIQRAYNAGRAFAPEGASVQFGNQFLITEDKIEVLDLVLENNDNGDHPFHLHGYSPWMIGVGDSPYDPNNVTLNTVNPLSRDTVEIPANGWVRLRFITYNPGAWTLHCHISWHMSAGLLMQFVTLPSVAATLPIPQVIANMCSAA

SEQ ID NO: 695 - protein, 525 aa, Trametes sp. AH28-2
MGKLQSFVNVVALSLSLSRGVLGAIGPVTDLTISNADVTPDGFTRAAVVANGVFPGPLITGNKGDNFQINVIDNLTNATMLKTTTIHWHGLFQHGTNWADGPAFVNQCPIASGNSFLYDFTVPDQAGTFWYHSHLSTQYCDGLRGPLVVYDPSDPYASMYDVDDDTTVITLSDWYHTAAKLGPAFPPNADSVLINGLGRFAGGNASDLAVITVEQNKRYRFRLVSLSCDPNFTFSIDGHNMTIIEVDGVNHEPLEVDSIQIFASQRYSFVLNATQSVDNYWIRAIPNTGTIDTTGGLNSAILRYSGADIVDPTANATTSVIPLVETDLVPLDSPAAPGDPVVGGVDLAMNLDFSFNGTNFFINNETLIPPTVPVLLQILSGAQSASDLLPTGSVYTLPLNSTIELSFPITTVNGVTNAPGAPHPFHLHGHAFSVVRSAGSSDYNYVNPVRRDTVSTGNPGDNVTIRFTTDNAGPWFLHCHIDFHLEAGFAIVFAEDTPDTASVNPVPTAWSDLCPTYDALDPSDH

SEQ ID NO: 696 - protein, 494 aa, Ashbya gossypii ATCC 10895
MTEEVRKQAQQLTLDTQRSEEHSGNVVVVSNRLPVTIKKNDSGEYEYSMSSGGLVTALQGLKKSTKFQWYGWPGLEIPEGDREQVQRDLLEKFNAIPIFLSDELADLHYNGFSNSILWPLFHYHPGEINFDENAWLAYNEANRAFAEAIQKNLRDDDIVWVHDYHLMLLPELLRNYIATANLQNVKLGWFLHTPFPSSEIYRILPVRQEILRGVLSCDLLGFHTYDYARHFLSSVHRILNVNTLPNGVKFQGRFVNVAAFPIGIDVNNFTEGLQKESVVQRVKQLKETFKDCKIIVGVDRLDYVKGVPHKLHAIEVFLNEHPEWIGKVVLVQVAVPSRGHVEEYQYLRNVVNELVGRINGQFGTVEFVPIHFMHKSVPFEELISLYSISDVCLVSSTRDGMNLVSYEYIACQAENKGSLILSEFTGAAQSLNGAFIVNPWNTDELAEAIHESLTLPIEKREANWEKLYKYISKYTSSYWGETFVHELYKLSSQK

SEQ ID NO: 697 - protein, 268 aa, Oryza sativa
  misc_feature (193)..(193): Xaa can be any naturally occurring amino acid
  misc_feature (204)..(204): Xaa can be any naturally occurring amino acid
  misc_feature (224)..(224): Xaa can be any naturally occurring amino acid
MAAPSVAVDNLNPKVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIASHGWSSCPVXLNESTGWGLEXISDLKKPTPKNSRLKGFDVXRALVVYQSQENPTGAGFLAGRKTKRGTKGKFSAKKEGKFCFFRG

SEQ ID NO: 698 - protein, 163 aa, Glycine max
  misc_feature (17)..(17): Xaa can be any naturally occurring amino acid
  misc_feature (27)..(27): Xaa can be any naturally occurring amino acid
PTPPPPTRTPPQPPPPXPPPPHPTPPXSPPTTPPPPPPLTLSTPPHTNPPPTHPAIPPPPHSALPTPPPPPVILPPTRTPPRPFPPAPQAGTVPHFSPSLKLLQPPGISTVPGPGFGQKKGVFLLRPTILPAEEPMPHFMDSFQKFNDEIMDQFQADRGYSRL

SEQ ID NO: 699 - protein, 88 aa, Glycine max
  misc_feature (38)..(38): Xaa can be any naturally occurring amino acid
GDEIYRDASLSLIPNVPAQILMGDMLHPPPPAHISYDXFVTQSTGRPMSLTTTAKILTDGNFSCTNEISSCTERTMKSFPHILMPPRT

SEQ ID NO: 700 - protein, 840 aa, Coccidioides immitis RS
MTIFIVSLDPHAPLWGATGVFNQPRPRPSQSPSSSILQHNSIAGPAPKLVKRASTPVKLEERPESSPPEKAFSDAAWTIEPSEQGNGGLFNAIRSANLEAPQDKLWVGTLGMPTDALEDHVKDTIAEKLDVDYACLTVFANDSDFDGHYLHFCKTILWPVFHYQIPDNPKSKAYEDHSWVYYKAVNQAFADRIVRNWKRGDIIWVHDYHLLLVPSMIRKQLPDAKIGFFLHTAFPSSEVFRCLSVRKELLYGILGANLVGFQTQEYCHHFLQTCSRILTVEATNEGVQLEDRFVNVGTFPIGIDPPSLDLRRKGTDVENWMRTIRDRYQGKRLVVARDKLDNIRGVRQKLLAYELFLNKYPKWRDSVVLIQVASSSAEHSELDATISDIATRVNSLHSSLAHQPLVFLNQDLLFPQYLALISVADVFMVTSLREGMNLTSHEYIHCQDGKYTNNKHGPLILSEFTGSASVFEGHPLLVNPWNYQQCADALNTALEMPPEEREQQWTRLNDQVNAHTTDKWVKNYIEALDRAFSEQACRDNVSIPRLSVNNLMKLYRASSRRLFIVDYEGTLASWGSPTSIVLTTPKRAIDTLNDLLEDPKNTIYVMSSRMPEEMERLFRQVPGLGLIAENGCFVREAHREEWIKLIDDEETREWKDSLADMINYFHVRTEGSWVEERHSSLVFHYDNAEDPQTAGRHASDCANHINDTCQQHRIRAVAVDGAVITEPISPNKATAADLVLRHILARAEKDKDSAAKPDFLFVAGDGREDEVVFRWANKLEEKKLIENIETVTLGSANTEAKATLAQGVTGVLSCLGKLAAISHDVEPNEYLAEREIPYKI

SEQ ID NO: 701 - protein, 409 aa, Ralstonia metallidurans CH34
MKPIQKSHKLQNVCYDIRGPVLEKAKQMEEEGHKIIKLNIGNLAVFGFDAPEEIQQDMMRNLPNSAGYSDSKGIFAARKAIMHYTQEKKIQGVGLDDIYVGNGASELIVMAMNALLNSGDEMLVPAPDYPLWTAAVSLSGGTPVHYVCDEANEWMPDLDDIRRKITPNTRGIVIINPNNPTGALYSDELLKEIVAIAREHGLIIFADEIYDKVLYDGNTHTSIGSLSTDVLTVTFNGLSKNYRSCGYRAGWMVVSGDKRPALDYIEGLNMLSSMRLCANVPGQWAIQTALGGYQSINDLVTEGGRLRRQRDLAYELITKIPGVTCVKPKAALYLFPKLDLSMYPIQDDQEFIYELLQESKVLLVQGTGFNWGAPDHFRIVFLPHEEDLREAITRVGRFLESYRKRHGTA

SEQ ID NO: 702 - protein, 404 aa, Shewanella oneidensis MR-1
MRPIIKSNKLDTVCYDIRGPVHKEARRLEDEGHRILKLNIGNPAPFGFEAPEEIVRDVILNLPSAQGYCESKGLFSARKAIVQHYQAQGIYDVDIEDVYIGNGVSELIMMAMQGLLNTADEILIPSPDYPLWTAAANLAGGKAVHYRCDEEADWFPDLDDIKSKISSRTRGIVLINPNNPTGAVYSKELLLQVVELCREHNLILFADEIYDKILYDEAKHIPAASLSDDILTVTFNGLSKAYRAAGFRIGWMMLSGNLKAAKSYIEGLDMLASMRLCANVPNQHAIQTALGGYQSINELILPSGRLTVQRDTCYELLNQIPGVSVKKPKGALYAFPKLDMKKFNLRDDERLVLDLLRDKKILLVHGTAFNWPEPDHLRVVFLPYKEDLTKALTEFGNFLETYKQ

SEQ ID NO: 703 - protein, 378 aa, uncultured bacterium
MDERIEIYSLSDIALILPLRDGMNLVSKEFVASRHDGTGVLILSELAGAAKELHEALLVNPNNLDEIAEAIREAVEMPNEEQVQRNKMMMQRLQRYNIHRWASEFMKSLEGVKEIQQVRLTRKVNTTRMHQIIDTYRVSKKRILFLDYDGTLSWFQENPEDARPDDQLYTILQHLTKDDKNTVVIISGRDKETLGLWFDNTWNIHFIAEHGVWIRDPGGEWHMLEQIDNDWKDPVQPLLEYYVDRTPRTFIEHKNFSLVWHYRNADPDLGLQRAWELKDELRTLTANLNLEIMDGDKVLEIKHAGINKGRAALQKMGNDRYDFIFAVGDDWTDEYTFESMPEESYTIKVGTKTTSAAYYIESVELVREMLCRFSQEEC

SEQ ID NO: 704 - protein, 118 aa, Triticum aestivum
  misc_feature (83)..(83): Xaa can be any naturally occurring amino acid
  misc_feature (94)..(94): Xaa can be any naturally occurring amino acid
  misc_feature (99)..(99): Xaa can be any naturally occurring amino acid
  misc_feature (103)..(103): Xaa can be any naturally occurring amino acid
  misc_feature (107)..(107): Xaa can be any naturally occurring amino acid
FERDDGIFTVLSERATALHKAFSQMEGVECAEPQGSMYLFPTINLPAKAAEAAKAEGRSADEFYCMRLLEATGICVVPGSGFXQKENTLHFRTXFLAPXTERXGRIXKFHNEFLDKYR

SEQ ID NO: 705 - protein, 168 aa, Prosthecochloris aestuarii DSM 271
MKKIGLFYGSTTGNTETAATAIAAALGIGNVTLHDIAETPPETLSSYDNIILGTSTWGFGELQDDWQNALSEIENLDFTGKTVAFFGLGNQYSYSDVFQDAMGILYETVHKKGADIVGAWPTAGYEFDESRAVVNDNFIGLALDNDNQPDRTPQRIEQWAGQLKNLFQ

SEQ ID NO: 706 - protein, 170 aa, Nostoc sp. PCC 7120; identical to SEQ ID NO: 12

SEQ ID NO: 707 - protein, 1116 aa, Debaryomyces hansenii CBS767
MTIIIGTLFLPYTVKFDVGGRVDYDIDITQKDATVPNIQNDARNQQRKSVSAGMGTGISQSSILPSLSTSQQHTPRSGSPTFNDNASIMTGSDTDQVNSAQEFFHSHKRTPHDSQNILTDNLYDKLGSKLIQPRSRYSNVAFQSLVVDPKKKSEDAGLPGLKINRSSNNLTSLNNSSFSSYSNMIGLNPTTNSSTMSVPSTRQRTPISRQGFTLHSNSSSNSIPTRIKEVEEEEARESDYASDKSVDEDHIENFNDLVHGRTESKLTPFGGFSKPDLEDGILNQENIFEDAPWKVVLAGKGNVSLTKAVQIAVDAGGINDHKWVGTLAMPSDAVPNSVINGISDSLSENYDCEAVFPNDITFQGHYKSFCKQILWPTLHYQIPDDPKSKAFEDHSWGHYKLLNQLVADKIVDLYKKENGSSDPNDPNNMIWIHDYHLLLVPKMIREKLPEAKIGLFLHVSFPSSEVFRCFAQRKAILSGMLGANCITFQTDEYVRHFWQTCNRLLLADANEFGITYEGKFTMINTIPVGVDAKSLEGYLGSNEVNEWRNMIRERWSNKKLIVSRDKLEKLRGIKQKLLAYEKFLHSNPEYVDTTVLIQICPGTTQDSSYESEIMSIVGRINALTGDISFSQPVVLLQQDIGFEQYVALQCEAEVFVVASMREGLNLTCHEYIIATTEKKSPLMLSEFTGSSPLLNCNGEGAILINPWDLKRFAELFKVLLDMGQDEKVKRWTNCYKTICNHDSRNWVENCLQGINEGWDYDHSRNLNKLIPFTRDIFDSFYSRNDGGKRLFFLNLDTPSAIASTNDPSSKFHKLTSKSAVAAAGKNGAFSESSRFASLLNELLSDPLNHVYLTSYLKRSDLDTLYNRSPNLGLVAENGGYIKLTESDKWISIIDEVELEGWMPQVSQLIASKVERLPGSHMEVEDCTIRFHPGKSFENDRERSLSILGDCIQHVNELFLDQDGVHATLIRNVLIVQKNKLSMKALKFIISYYNQKKQGIKSESLIEEYQVKQVPGSAPSTPISETASLPPIKSPTSKIQKNLVTALFLSGGSTLIDEPGYEYANGLERSGEIPEVITVTVLGADSRTSATYCVSGKNELLGILSNPVSEPYKSHTA

SEQ ID NO: 708 - protein, 505 aa, Schizosaccharomyces pombe
MFTDYPNDINCESPRMSDLDGFCQNAFSDLNSLNQQVFKANYAVRGALAILADEIQDDLLENPSSYPFSEIVYANIGNPQQMGQSPITFVRQVLSLCQYPTLLDHAEEKWFQNLFPTDVVQRSKMLLKESGSLGAYSASQGIPLVRRHVADFIRARDGFDCEPSDIYLTSGASHAARLIMTLIIARPTDGVMVPAPQYPLYGAQIDLMSGSMVSYSLSEENNWDIDFDQFKKSFDEASKKGINVRLCVVINPGNPTGACISENSMEKVLRFAKAKGIVLLADEVYQNNIYQNKFHSFRRKLGELREKEPDNHWDQVSLISVNSVSKGQFGECGQRGGYLDVVNIPEPAKDQILKLATIDICPPVAGQLLVDMLVNPPKPGDPSYDLFIKEVDEIHEALRLQCRQLYEGTKRMKRVSCLEPHGAMYLHPSVSLPEKLITTAKAQKIQPDEFYAIELLKRSGICVVPGSGFGQPEGDYHIRITFLAKGTEYIERFVKAHNEIMDLYE

SEQ ID NO: 709 - protein, 524 aa, Trametes sp. I-62
MSGFRLLPSFASLAVIVSLALNTFAAVGPVTDLTISNANVSPDGFQRAAVVANGGVPGPLINGQKGDHFQINVVNQLTNHTMLKSTSIHWHGFFQKGTNWADGPAFVNQCPIATGHSFLYDFQVPDQAGTFWYHSHLSTQYCDGLRGPFVVYDPNDPHASLYDVDNEDTVITLADWYHVAAKLGPAFPPRADATLINGLGRSTDTPTADLAVIKVTSGKRYRFRLASLSCDPAFTFSIDNHDMTIIEADAVNTQPLEVDSLQIFAGQRYSFVLEANQAVDNYWVRANPFFGTTGFAGGINSAILRYDGAAEVEPTTTQSTSTKPLAETDLVPLASMPVPGSPVSGGVDKAINFAFTFNGTNFFVNGATFTPPSTPVLLQIMSGAQDASALLPSGDVYSLPSNATIELTFPATTGAPGAPHPFHLHGHTFAVVRSAGSTKYNYDNPIWRDVVSTGTPAAGDNVTIRFRTDNPGPWFLHCHIDFHLEAGFAVVMAEDIPDTKLANPVPQAWSDLCPIYDALDPSDQ

SEQ ID NO: 710 - protein, 168 aa, Chlorobium tepidum TLS
MKKTAVVWASQTGNTKEAAELIATEIGRPDVDLFEVSREELLRLTEYDMLIIGTSTWGAGELPHGWREAVSALDQLDLTGKTVAFFGLGDQLVYGDWYVDAMGILHDRFVSRGAKVVGAWPSDTYEFSSSKALRDGMFVGLALDADNQEHLTRERIRRWVCSIRPYLS

SEQ ID NO: 711 - protein, 175 aa, Vibrio sp. Ex25
MNIMKIGLFYGSTTCYTEMAAEKIRTIIGEDLVDIHNVKETPLSLMADYDLLLLGISTWDFGEIQEDWNAIWQDIATTPLKGKVVALFGLGDQEGYGEWYLDAMGLLHDELQATGATFIGYWPNEGYEFEASKALIEDGSKFVGLALDEDSQYELSDERIEKWCEQVLVEFHDTL

SEQ ID NO: 712 - protein, 399 aa, Triticum aestivum
  misc_feature (151)..(151): Xaa can be any naturally occurring amino acid
  misc_feature (255)..(255): Xaa can be any naturally occurring amino acid
  misc_feature (288)..(288): Xaa can be any naturally occurring amino acid
  misc_feature (323)..(323): Xaa can be any naturally occurring amino acid
NKFVQKSRLVPVRNSRDIVDPRVRRQVVALCQAPFLLDDPNVGLIFPADAIARAKHYLSLAPGGLGAYSDSRGIPGVRQEVAEFIQRRDGYPSDPELIYLTDGASKGVMQMLNAIIRNERDGILVPVPQYPLYSAAISLFGGSLVPYYLEXEANWGLDLVSTRQSVAEARSKGITVRAMVIINPGNPTGQCLSEANIRELLNFCYQENLVLLADEVYQQNVYQDERPFISARKVMFDMGPPVSREVQLIPFHTVXSKDFGGEWGQRGGYFEMTNIPSKTVDEIYKESXWTLSPNVPGHIFMGLMINPSKTVYILYLTNSIQAXTFLQSAMTTAQIMTDCFHRVLMLLFYSSKRAVIISLFLKLQDLLMKTNFPMKDIFSISITIIPCTSNHQRLLHNAS

SEQ ID NO: 713 - protein, 601 aa, Arabidopsis thaliana
MANVEADFRTSGSNDDELYTELWKACAGPLVEVPRYGERVFYFPQGHMEQLVASTNQGVVDQEIPVFNLPPKILCRVLSVTLKAEHETDEVYAQITLQPEEDQSEPTSLDPPLVEPAKPTVDSFVKILTASDTSTHGGFSVLRKHATECLPSLDMTQPTPTQELVARDLHGYEWRFKHIFRGQPRRHLLTTGWSTFVTSKRLVAGDAFVFLRGETGDLRVGVRRLAKQQSTMPASVISSQSMRLGVLATASHAVTTTTIFVVFYKPRISQFIISVNKYMMAMKNGFSLGMRYRMRFEGEESPERIFTGTIIGSGDLSSQWPASKWRSLQIQWDEPSSIQRPNKVSPWEIEPFSPSALTPTPTQQQSKSKRSRPISEITGSPVASSFLSSFSQSHESNPSVKLLFQDPATERNSNKSVFSSGLQCKITEAPVTSSCRLFGFDLTSKPASATIPHDKQLISVDSNISDSTTKCQDPNSSNSPKEQKQQTSTRSRIKVQMQGTAVGRAVDLTLLRSYDELIKELEKMFEIEGELSPKDKWAIVFTDDEGDRMLVGDDPWNEFCKMAKKLFIYPSDEVKKMRSKSLLGDKGTIVNLESDQRTVHV

SEQ ID NO: 714 - protein, 449 aa, Arabidopsis thaliana
MNHNSNLVLPSHQTETQTQDETDISVWRFRGSDNAAKASSVTMRVIVYKLFDECSLDVKKPLLPLAHGDPSVYPCYRTSILVENAVVDVLRSGKGNSYGPAAGILPARQAVADYVNRDLTNKVKPNDVFITVGCNQGIEVVLQSLARPNANILLPRPSYPHYEARAVYSGLEVRKFDLLPEKEWEIDLPGIEAMADENTVAMVIINPNNPCGNVYSYDHLKKVAETAKKLGIMVITDEVYCQTIFGDKPFVPMGEFSSITPVITLGGISKGWIVPGWRIGWIALNDPRGILKSTGMVQSIQQNLDITPDATTIVQAALPEILGKANKELFAKKNSMLKQNVELVCDRLKEIPCLVCNKKPESCTYLLTKLKLPLLEDIEDDMDFCMKLAKEENLVLLPGVALGLKNWIRITIGVEAQMLEDALERLNGFCKRHLKKTESSFQALSNGKI

SEQ ID NO: 715 - protein, 137 aa, Arabidopsis thaliana
  misc_feature (21)..(21): Xaa can be any naturally occurring amino acid
KGAMFLFPQIRVPPGAFQSAXKQSGKGPPVFYCLKLLKAPGISPVPGFGFGQKKGVFPLGATILPPKNEMPGIMESFKKFNAGVMTQDDKNFGYSKKGILFFLNDYWVLLPSLKVNFCRTLFFFALFYKPNFFFWVS

SEQ ID NO: 716 - protein, 458 aa, Burkholderia thailandensis E264
MSRLIIVSNRVAPISEGEPAAGGLAIGVYDALKETGGTWFGWSGEVVASGAPQIRVEEHGPVTFATIGLSRRDYDQYYRGFSNATLWPAFHYRADLIQFDRHEFEGYSRVNVWLARQLVPLLRDDDVIWVHDYHLIPFAQALRAAGVKNRIGFFLHIPFPAAQVLVNVPPHRELVEALCSFDLLGFQTDTDLRAFFEYVECEAGGAVDRAAHPARVEAFGRTLRAAAYPIGVYPDEIAALAKAGENGRAVKALAASLRGRQLVMSVDRLDYSKGLVERFRAFEKLLEHETSFRNHVSFLQIAPSTRADLRAYQDIRRQLEGESGRINGRFAELDWAPILYIHRQYERPVLAALYRLARVGYVTPLRDGMNLVAKEYVSAQDPDDPGVLVLSRFAGAACELTGALIVNPIDIAGMADALSRALSMPLAERRARHADMLARLRENNVSVWRDNFLRDLGR

SEQ ID NO: 717 - protein, 564 aa, Physcomitrella patens subsp. patens
MASMKMSSFKVLCFIAIIVAVFTQKAVATSKTHHLNWTVENKRVTRNCATVDIPTVNGRFPGPTIEVNEGDTLVIKVTNKQQYPVTLHWHGIKQFRTNYADGPAHITQCPIQPNKSYIYEFTLNDQRGTFFWHAHINWMRSTVHGALIVHPKKKAPYGAVAGEIPIIMGEFFGLHPNVVELGFINTLAPVENRTTLASTINGFPGPFFNCSSATKVYKVKKGKTYLLRIIDAALNSDHYFAVANHSVTVVAADGNYLKPFKTSYVPMSPGQTTDVLIKFDKPCGRYYFGMNAGPVPAVGAPPPFVPAVSIFQYEGADSTTSPVVPVFPDRFNLAPLNAYHAKLKNLNRYHLPRKVDKSFLYVVGISSVNCIPSENCTRKIAGTMQNMTFDDPVGTSILEAYASGAKGVYTTDFPAQPPSLNVNTTRPDPHYLAGNRGTRLRELKFGSVVQVVLQNFFAFGVLDHPFHLHGHDFYVVGQNYGVYDPVQSPKTFNLKDPPLFNTIGVPNGGWVALRFKANNPGVWLLHCHFERHKSWGMHQVFITRNGVGKSQTLPGPKHPLPKCT

SEQ ID NO: 718 - protein, 595 aa, Magnaporthe grisea 70-15
MGIMQGMASRAAGDVKMLAAALSQDATNGKSKLGTFMAPMLPFFLANNAAMQHGKPWGDRTVEGTNPYRQAPTTGSIRSYDWTISRGTIAPDGYEVPALLINGQYPGPMIEANWGDTVQVTVHNNITGPEEGTAMHWHGLLQRGTPYQDGVPGVTQCAIAPGQSYTYSFLADQFGSSWYHSHYSAQYSSGVVGPMVFYGPGRQFYDVDIGPVMLSDWNHQNYQDIIEKMLQPAAKGGNLKVTSDNNLINGKGVFDCSTMAKGDKTRCTPNAGYSKFKFQSGKVHRLRLMNTGSDGIQRFSIDEHMMTVIANDYVPIRPYQTKVVTLGVGQRADVLVKADQAPGSGFWMRSTLAACSEARQPNALAVVYYDEDGDTTPASKPWDVADPKTCANDDISESVPIFRMPVAQPTTTQEFVAEIFTNSSGVSLFKFGGVSARVDMNAPPLLLANVGNTSFPAEWNVHNFGGSKVVRLVVTNKTPGAHPMHLHGANVQVLAEGSGAWDGSTITNSDNPIRRDTQLVRPNGHVVLQFDADNAGVWPFHCHIAWHASAGYFSSVLTQPDLVKGMSMPMTIAQTCRDWAAYTQTNIPDQIDSGV

SEQ ID NO: 719 - protein, 541 aa, Glycine max
  misc_feature (194)..(194): Xaa can be any naturally occurring amino acid
  misc_feature (202)..(202): Xaa can be any naturally occurring amino acid
MRKYAADRFRHLFNRSLLLLRHRHHHNHHPFPYSSSVSSLSPFSRSRFLSSTPFSMASDSPFPVTAQNINPKVLKCEYAVRGEVVTLAQNLQKDLQANPGSHPFDEILYCNIGNPQSLGQQPITFFREVLALCDHPAILDKSETQGLFSTDAIQRAWQIVDQIPGRATGAYSHSQGVKGLRDTIAAGIEERDGXPANPDDIXMTDGASPAVHNMMQLLIRSENDGILCPIPQYPLYSASIALHGGCLVPYYLDEATGWGLEIPELKKQLEAAKSKGINVRALVVINPGNPTGQVLGEANQRDIVEFCKQEGLVLLADEVYQENVYVPEKKFHSFKKVSRSMGYGENDITLVSFQSVSKGYHGECGKRGGYMEVTGFSAEVREQIYKVASVNLCSNISGQILASLVMSPPKVGDESYDSFMAEKENILASLARRAKTLEDAFNKLEGVTCNKAEGAMYLFPQIRLSEKAIKAAEAANATPDNFYCKRLLNATGVVVVPGSGFGQVPGTWHFRCTILPPEEKIPAIVTRLTEFHEKFMDEFRD

SEQ ID NO: 720 - protein, 642 aa, Zea mays
  misc_feature (44)..(44): Xaa can be any naturally occurring amino acid
MVQLLPALVALALLLVRPVADAAMAKYTFTVGSMQISQLCSSTXSIIAVNGQLPGPSIEVNEGDDVVVKVVNNSPYNVTIHWHGVLQLMTPWADGPSMVTQCPIQPSSSYTYRFSVPGQEGTLWWHAHSSFLRATVYGAFIIRPRRGNAYPFPAPDKEVPIVLGEWWNRNVVDVESDAILAGQLPAQSDAFTVNGKTGLLYQCANETFTAVVEPSTRVLLRVVNAGLNSHLFFKLAGHNFTVVAVDAGYTSNLNTDTLVLAPGQTVDALVTTAAAPGSYYMAVLAHDTMSPLAFAASDTTTATAILQYNGTSSTNPPAMPAMPSSSDSGTANAFYFGLRGLGAPAVPAPVDVSMTIELGLGQLPCDPSQTRCNGTAAAAAMNGVSFRLPSPETSLLGAHVDGVAGVFTADFPDGPPPSGTAMSVGTKLKKLSYNSVVEIVLQNPAAVPTENHPIHLHGFNFFVLAQGMGTFAPGSVAYNLVDPVARNTIAVPGGGWAVIRFVANNPGMWFFHCHLDPHVPMGLGMVFQVDSGTTPGSTLPTPPGDWVGVCDAQHYAAAAAVAAAPVPVPAPAPVPAPILAPAPAESPLPPPRAVDHKPSPNLPQRREHTGTSNSAAGRRAKGHLACFLCSVLLFFLLRQHKA

SEQ ID NO: 721 - protein, 397 aa, Thermococcus litoralis
MVKASKRAMSIEYAIRDVVLPARELEKQGIKIIKLNIGDPVKFDFQPPEHMKKAYCEAIMEGHNYYGDSEGDRELREAIVEREKKKNGVDITPEDVQVTAAVTEALQFIFGALIDGGEEILIPGPSYPPYVGLVKFYGGVPKAYRTVEEEGWQPDIDDMRKKITEKTKAIAVINPNNPTGALYEKKTLQEIIDLAGEYDLPIISDEIYDLMTYEGKHVSPGSLTKDVPVIVMNGLSKVYFATGWRLGYMYFVDPENKLAEVREAIGKLARIRLCPNTPAQKAAIAGLRGPMDYLEEYMAKLKERRDYIYKRLNEMPGISTQKPQGAFYIFPKIEEGPWKSDKEFVLDVLHNAHVLFVHGSGFGEGGEMHFRSIFLAPVPVLEEAMDNLEKFMKERLG

SEQ ID NO: 722 - protein, 484 aa, Desulfovibrio desulfuricans subsp. desulfuricans str. G20
MTPAKGLIVVSNRLPVVLSRNEDGWGITTGAGGLVSAMAPVLRDRGGTWVGWTGASGEHEAESLLGEFSREAGYSLKPVRLEKEDVADFYYGFANEVIWPLFHDFQSLCNFFPKYWKSYLRVNELYARAVMDSGDPEAYVWVHDYHLMHVGEMLKSMGSRRRAGFFLHIPFPPMDNYLKLPWRRRLLSALLEYDLVGFQTYRDRRNFMQSVQVLLPHVKPQGRGPVIELLLDGRKVRLGAFPISIDYRSFVRTARSPAVSGRVNELKSAMDGRRMLLAVDRLDYSKGITFRLEAFREALEKYPGLRGNVTLMQIMVPSRQEVPRYNALKQEIERLVGEINGLFSRPGWNPVQYQYRSLGREELVAYYRAASMAIVTPLRDGMNLVAKEYCACNVNRRGVLLLSEFAGAAAQLQNGAVLVNPFDREGMAQSIKEALDMPAEEARRRMDRMRDVIRKNDIFRWVDMFLLAAFSRHLDDFPPTYARK

SEQ ID NO: 723 - protein, 507 aa, Saccharomyces cerevisiae
MTMTHQQDLKGVFTAKDLDFKPAGKITKKDLNTGVTKAEYAVRGAIPTRADELKEELKKNPEVLPFDDIINANIGNPQQLDQKPLTFTRQVLAILEYPEILRVGHNELASLNLFSRDALERAERLLNDIGGSIGAYSHSQGVPGIRQTVADFITRRDGGEPATPEDIYLTTGASSAATSLLSLLCKDSQTGLLIPIPQYPLYTASASLFNAQVLPYYLDEESNWSTNSDEIEKVVQDALKKQIRPSVLIVINPGNPTGAVLSEETIARICLIAAKYGITIISDEVYQENIFNDVKFHSMKKVLRKLQHLYPGKFDNVQLASLHSISKGFMDECGQRGGYMEIIGFSQEIRDALFKLMSISICSVVTGQAVVDLMVKPPQPGDESYEQDHDERLKIFHEMRTRANLLYETFKELEGIECQKPQGAMYLFPRLVLPKKALCESERLGIEPDEFYCTSLLESTGICTVPGSGFGQRPGTYHVRTTFLAPGTKWIQDWKEFHQDFFSKYRN

SEQ ID NO: 724 - protein, 157 aa, Brassica napus
MFDMGPPISSELQVVSFHTVSKGYWGECGQRGGYFEMTNLPPKTVDEIYKVASIALSPNVPGQIFMGVMVNPPKPGDISYLKFAAESKSIHESLRRRARMMTDGFNSCRNVVCNFTEGAMYSFPQIRLPPRAIEAARRAGQSADVFYCLKLLEATGI

SEQ ID NO: 725 - protein, 174 aa, Mannheimia succiniciproducens MBEL55E
MAIVGLFYGSDTGNTENVAKMIQKQLGNELVDIRDIAKSTKEDIEAYDFLMFGIPTWYYGEAQCDWDDFFPTLEQIDFTDKLVAIFGCGDQEDYADYFCDAMGTVREIVEQRGAIIVGNWPTEGYSFESSRALINNDTFVGLCIDEDRQPELTAERVNTWVKQVYDEMCLAELA

SEQ ID NO: 726 - protein, 433 aa, Picrophilus torridus DSM 9790
MKYLVVTSRGPFSHEKKGKNETIENNVGGVATALKMLLSKNGGTWVCWGSGSLDINYKSENFSNYVIKRIILNSTEKKKFYDEYSNGTLWPVFHYFRDRTTFYKDAFRYYLEVNRKFAREVIENIDDDTVIWIHDYQLAMLPGILRESNVKNKIIFTWHIPWVSPEFFSIIPESREIIKSISSSNYITFHIDNYRENFINSQRFLLGSSTPSRVYSIPLGIDTKFFSPKNAKKINNIKAKIIFSIDRLDYTKGLTLRVLAIEDLLTEHPELLKKFVYIMNVTPSRTTVSEYINMKKELEMSVGRVNGRFGTIDWRPIIYMYRKIRDKTLLSYYKSADVALITPLIDGLNLVSKEFVATTENGVLIISRFAGASKELSSAITVNPYNIKETANAIIKALSMDVNERNNMISKLKNTVVKRDIKWWYRRITALPR

SEQ ID NO: 727 - protein, 64 aa, Glycine max
  misc_feature (46)..(47): Xaa can be any naturally occurring amino acid
  misc_feature (53)..(53): Xaa can be any naturally occurring amino acid
MALEYDLLNENVKKCQYAVRGELYLRASELQKEGKKIIFTNVGNPXXLGQKPXTFPRQVVALCQ

SEQ ID NO: 728 - protein, 522 aa, Pleurotus ostreatus
MIAPVLSFGLTVLSLLSPTNAAIGPVAELDIVNRHIAPDGYSRQAILANGIFPGPLIVGQKGDTFRLNVKDSLNDPTMKTSTSIHWHGLYQEKTTWADGPAFVTQCPIVPGHSFEYNFHVPEQAGTFWYHAHYGTQYCDGLRGPFVIYDDCDPHKDLYDVDDESTVLTIGDWYHPTAEELVARGGPPQPDLTVFNGIGRSVDGPPVPLYVLNVEQGKRYRIRLINIACEPNYNFTIDGHQMTIIETDGENTVPLDVDAIDIFASQRYSFVLHANQPIGNYWIRGNPSAGPTGFQNGINSAILRYKGAPLVEPSTPYINATNPMREVDLHALENPAAPGLPFPGGADILLNFAFSFDPMTSRFATNGVSFQSPTVPVLLQILSGAQSAQSMLTEGGVYTLPPNKVIEISMPGGVNGGPHPFHLHGHTFSVVRSAGSSVYNYENPVRRDVVSIGDRGDNVTIRFVTDNNGPWFLHCHVDWHLDLGLAVVLAENPRDVPYDEPIPQAWYDLCPIYDDYNRTHPST

SEQ ID NO: 729 - protein, 532 aa, Pleurotus ostreatus
MRTFSRFLASLTLFLWLQSGANAVETIGPTGNMRIVNKVVSPDGFSRSAVVAGKTTAGATNPGVLIRGWKGNNFKLNVVNELTDTTMLKTTSIHWHGFFQAGTSWADGPAFVTQCPIAAGNSFLYDFKVPDQAGTFWYHSHLSTQYCDGLRGAFVVYDLFDPHRLRYDIDNADTVITLEDWYHVVAPQNGPIPTPDSTLINGLGRYAGGPTSPLAVVRVLWGLRYRFRLVSLSCDPNWTFSIDGHKLLVIEADAVNVQPVEVDSIQIFAGQRYSFVLKANQQIGNYWIRAQPNLGTVGYVGGVNSAILRYILAPNADPTTTEPASPVPLLETDLVPLSNPGAPGPPVPGGADVNINLALNFDFTTFEMTINGNPFHPPTAPVLLQILSGAVTAASLLPAGGVYELPPNKVIELSMPALAVGGPHPFHLHGHTFDVIRSAGMTTYNFDTPARRDVVNTGVSTDDNVTIRFVTDNPGPWFLHCHIDWHLEIGLAVVFAEDAPSVNTENPPASWDALCPIYDALTDEEKGGLLPT

SEQ ID NO: 730 - protein, 480 aa, Debaryomyces hansenii CBS767
MIKGKVLVVSNRLPVTIKRSPNGTYDYSMSSGGLVTALQGLKKSTEFQWLGWPGLEIPEDEQSKVNKDLMEKFNCTAIFLSDSIADLHYNGFSNSILWPLFHYHPGEMNFDENAWAAYIEANRKFAITIAQQVDDNDMIWVHDYHLMLLPQMLREEIENKKKNIRIGFFLHTPFPSSEIYRILPVREEILVGVLSCDLIGFHTYDYARHFLSSVSRIVSNVNILPNGIEYQGRSIGIGAFPIGIDVDKFTEGVTKPKVVDRIKQLKQKFTDTKIIVGVDRLDYIKGVPQKLHAFEIFLTENPEWIGKVILVQVAVPSRGDVEEYQSLRATVNELVGRINGRFGTVEFVPIHFMHKSIPFDELISLYHISDVCLVSSTRDGMNLVCYEYIACQQENKGVLILSEFAGAAQSLNGAIVVNPWNTEELSYAIKESLTLPEEKKELNFKKLFDYISKYTSGFWGESFVKELRKCSSQDKITEIR

SEQ ID NO: 731 - protein, 524 aa, Frankia sp. EAN1pec
MAPRQGTRWPTLRCVRHMLGIGEFTAPGSEYPAQADLLIASNRGPVSFVVGDDGLLHPRRGGGGLVSGLAQVVQDTPEDGREIVWVCAALSDADRRAARSAPGGRIDRSGYDTGGASVRMLDLDRVLFDRAYNAVANRTLWFVLHLLHAPATEPSFGASFRKDWAAYEAYNAAFADALAELAAPGACVLVQDYHLTLVPARLRQMRPDLRIAHFSHTPWSPPEYFRMLPDDVSAAILHGMLGADRLGFLAPAWAAAFRDCCAEILGAEVVGDTVTAGGRTVRTSLYPLGVDAAELRDRAARPDVRARAAELRELAGGCRLVVRVDRTELSKNIVRGLDAYRELLRSHPEWHGRVMHLVCAYPSRHDLPEYREYTAAVQRLAAEIEDEFGTDTWLPVHLEINDDFPRSLAAMTLADVLVVNPIRDGMNLVAKEGMVVSADGGVLVLSREAGACSQMGADAVVVNPFDVTATAEAMHTALVMPAAERRERARRLAAVAGELPPRAWFRAQLDEIRGHAPAEPDRAG

SEQ ID NO: 732 - protein, 214 aa, Brassica napus
AEHGYFTRRNSDSPWETTVLPTDLGWKKIAEPVMSHYTEATDGSFIEEKESAMVWHHQEADPSLGSWQAKELLDHLESVLTNEPVVVKRGQHIVEVKPQGVSKGKVVEHLIATMRNSKGKRPDFLLCIGDDRSDEDMFDGIVKHQDVSPIAFAEVFACTVGQKPSKAKYYLDATPMVINMLEWLASASDKSKDGEQQSKFTFQQGHCRNEIIDL

SEQ ID NO: 733 - protein, 370 aa, Methanosarcina acetivorans C2A
MKEISFSENVSRIDTSGIRKIFEAAGSNAINLGLGQPDFDTPVHIKTAAIEAINEGFTGYTVGPGIPELREALSQKFLEENGFSVSPQEIIVTSGASEALTIALAALLNVGDEVLISNPGFVSYNALTEILNGKVVSVPLAEDLTMKPDAVLERITPKTKALILNSPSNPTGAVSSRADIKALAEIADDHNITIISDEVYEYFIYEGEHVSPASYSDNVVTINATSKSYSMTGWRLGYLAARKEYIAQMNKVHQYIQACANSIAQKAAYAAVTGPKDSVNAMREEFRKRRDLLVKGLNELGMECAFPKGAFYAFPKVENSAEVASKMISNGVVVVPGTAFGSEGDGYIRISYAASMKDIEKSLAIMEKVL

SEQ ID NO: 734 - protein, 481 aa, Arabidopsis thaliana
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 735 - protein, 280 aa, Cucumis melo
NFGDYNMWLAAENGMFLRPTKGEWMTTMPENLHMDWVESVKHVFEYFTERTPRSHFELRETSLVWNYKYADVEFGRLQARDLLQHLWTGPISNASVDVVQGSRSVEVRAVGVTKGAAIDRILGEIVRDKGINKPIDYVLCVGHFLTKDEDVYTFFEPDLPTEVPAAVARTTVTNPFGGVPVPKIPNTVVSPSRSARLKKQRSLSILERKANSHGSAVFWRPVVQDRLSLHEGSSVLDLKGDNYFSCAVGRKRSNARYLIGSSDDVVTLVKELSECSECQI

SEQ ID NO: 736 - protein, 206 aa, Glycine max
  misc_feature (75)..(75): Xaa can be any naturally occurring amino acid
TSSPSKAKFSFHSVSKGYYGECGQRGGYFEMTNIPPETVDEIYKVASISLSPNVPAQIFMGVMLNPPQPGDISYXQIVRESTGILESLRRRARIMTDGFNSCRNVVCNFTEGAMYSFPQIRLPPRALEAAKQAGKVPDVYYCLKLLEATGISTVPGSGFGQKKGVFHLRTTILPAEEDMPDIMDSFKKFNDEFMEQYEDDRGYSRL

SEQ ID NO: 737 - protein, 662 aa, Arabidopsis thaliana
MAASNHSSGKPGGVLSDALCRELWHACAGPLVTLPREGERVYYFPEGHMEQLEASMHQGLEQQMPSFNLPSKILCKVINIQRRAEPETDEVYAQITLLPELDQSEPTSPDAPVQEPEKCTVHSFCKTLTASDTSTHGGFSVLRRHADDCLPPLDMSQQPPWQELVATDLHNSEWHFRHIFRGQPRRHLLTTGWSVFVSSKKLVAGDAFIFLRGENEELRVGVRRHMRQQTNIPSSVISSHSMHIGVLATAAHAITTGTIFSVFYKPRTSRSEFIVSVNRYLEAKTQKLSVGMRFKMRFEGEEAPEKRFSGTIVGVQENKSSVWHDSEWRSLKVQWDEPSSVFRPERVSPWELEPLVANSTPSSQPQPPQRNKRPRPPGLPSPATGPSGPDGVWKSPADTPSSVPLFSPPAKAATFGHGGNKSFGVSIGSAFWPTNADSAAESFASAFNNESTEKKQTNGNVCRLFGFELVENVNVDECFSAASVSGAVAVDQPVPSNEFDSGQQSEPLNINQSDIPSGSGDPEKSSLRSPQESQSRQIRSCTKVHMQGSAVGRAIDLTRSECYEDLFKKLEEMFDIKGELLESTKKWQVVYTDDEDDMMMVGDDPWNEFCGMVRKIFIYTPEEVKKLSPKNKLAVNARMQLKADAEENGNTEGRSSSMAGSR

SEQ ID NO: 738 - protein, 172 aa, Idiomarina baltica OS145
MQIGLFYGSTTCYTEIAAEKIQQAIGEDIVSIFDIKDTPLKEAEQFDILILGISTWDFGELQEDWESHWDDITPLNLQGKIVALYGMGDQQGYTDWFQDALGMLHDAIADKDCKRIGFWPNQGYEFAASKALTEDQQYFVGLSLDEDTQYDLSEERIEQWTTQILEEIAEQL

SEQ ID NO: 739 - protein, 404 aa, Acidobacteria bacterium Ellin345
MSTLTKATPIQAADRMVNVRYAIRDLAVLADQVASQGNKILYCNIGDPCKYDFPVPVHIMEAAIKAMRDGYNGYGESLGIKPAVEAIRNEAERDGFKNIQGVFVGLGSGEAIDSCLTALLNPGENFLAPSPEYPLYGAITAKLGAEPNAYFLDESNDWQPDVEDLERRINAKTRALLIINPNNPTGAVYSRETLEKIADVARRHNLLLISDEIYNKLVFDPSAKHISIATLAPDVPCITFNGLSKAYLVPGWRIGWGVGTGPAELIKPFLENIYKLLRARLSAPHPYQYAVKAALEGPQDHLKWVNEKLAARAKVTKDWAASEPRVNLVAPKGAFYAFPSLDIPEDDLTFVSELLIQKHVLLVHGSGFGQKPGTHHCRIVTLPQEAVLTNAYAKVSEFLKERYQ

SEQ ID NO: 740 - protein, 601 aa, Arabidopsis thaliana; identical to SEQ ID NO: 713

SEQ ID NO: 741 - protein, 494 aa, Triticum aestivum
MSYNKTASITAETINPKVKIFDYEPCGEIARHAERLEQEMEKSPGSRPFPEITYCNLGNPQALGQRPITFFREVLSLCDNPALLRRDETRMLFSPCAINRARKIIESMPGRNSGAYTNSQGIRSLREAVASGIAARDGFPSRPEDIFLTDGASSAINLSMQILIRSQEDGVLCPLPEYPLYSASIILHGGTMVPYNLSEDGDWGLEIFEVKRCLEEARIAGLTVRAMVIINPGNPTGQVLSVTNQEEIVEFCRKEGLVMLADEVYQDNVYVEDRKFHSFKKVARSLGYDENDISIVSFHSVSMGFSGECGRRGGYMEICGFGDDVMGEIRKVASVTLCPNIGGQILTSLAMDPPKLGDGCFENFMAEKEDIRLSLAKRAKTLAGAFSSLEGMTCNRVEGAIYAFPRIHLPAAAIKAAKAEGMSPDLFYACRLLDATGIAVVPGSGFHQVSGRNKATGTWHIRCTILPGEDKIKVMIPRLKEFHESFMNEFRDRS

SEQ ID NO: 742 - protein, 189 aa, Vibrio vulnificus YJ016
MPTTDIIKGINSMASVGIFFGSDTGNTEAVAKMIQKQLGKKLVHVQDIAKSSKEDIDNFDLLLLGIPTWYYGEAQCDWDDFFPELEKIDFSTKLVAIFGCGDQEDYAEYFCDAMGTVRDIVEAKGGTILGHTSTESYEFEASKALVAGDDSLFVGLCIDEDRQPELTEERVKNWVEQIYEEMCLAELED

SEQ ID NO: 743 - protein, 160 aa, Xanthobacter autotrophicus Py2
MIVTVIFGSDGGATKGVASKISKKCQGRSVDIKAATKADFENSDLLILGSPTYGDGTLQTDWEENIDKLRSANLKGRKVALFGTGDQESYPTSFVDAIGILYDEVTDLGAVVVGFTDTAGYDYVGSTAERDGQFVGLALDLDTQSGLTDKRVTAWLSKLL

SEQ ID NO: 744 - protein, 404 aa, Neisseria meningitidis MC58
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLNDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 745 - protein, 496 aa, Gibberella zeae PH-1
MNTRTNYYQDHPNTGVIRKYDFTVNRAKIAPDGYELSTILVNGQFPAPLIEANWGLSLHWHGILQKNMPWEDGVPGVTQCPIAPGQSYTYSFIADLYGTSWYHSHYSAQYLAGLFGPLVIYGPQERKDYDIDVGPILLSDWYHKEYFDLVEEIMTPGAPGIVFSDSNLINGKMNFNCSSVQPGDKTPCKNNAGISKFRFRRGKVHRLRLINPSAEAIQRFSIDGHTMTVIANDFVPVEPYNTKVVTLGIGQRTDVLVKGNGKLESYWMRSNISANCSLARAHDALAAIYYDNANPKKEPKSKPWNIPDPATCANDDLSMTRPLMKLPLPPADKTIELDIASFKNASNITLWSLGGVAARTNYNSPTLLLSKLGNHTFDKEWNVINTGKAKSVRVVVNNKTPVAHPMHLHGFNMYVLHEGLGDWDGTIINEHNPQRRDVVQIRGRGHLVIQFDAGSNPGVWPFHCHIAWHVSAGLLAQFLTNPDQVEKLRSSASSVL

SEQ ID NO: 746 - protein, 517 aa, Trametes trogii
MARFQSLLTFITLSLVASVYAAIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGSPVPTADATLINGLGRSIDTLNADLAVITVTKGKRYRFRLVSLSCDPNHVFSIDGHSLTVIEADSVNLKPQTVDSIQIFAAQRYSFVLNADQDVGNYWIRALPNSGTRNFDGGVNSAILRYDGAAPVEPTTSQTPSTNPLVESALTTLEGTAAPGSPAPGGVDLALNMAFGFAGGKFTINGASFTPPTVPVLLQILSGAQSAQDLLPSGSVYSLPANADIEISLPATAAAPGFPHPFHLHGHTFAVVRSAGSSTYNYENPVYRDVVSTGSPGDNVTIRFRTDNPGPWFLHCHIDFHLEAGFAVVMAEDIPEVAATNPVPQAWSDLCPTYDALSPDDQ

SEQ ID NO: 747 - protein, 492 aa, Synechococcus sp. WH 5701
MKRGSSNFVLVYHRSPYEETFDSEGNRQWVDQKSPNGVIPTLRNLFLEERSGTWISWRQDANCSANADERLNLTSPSPFTLRRLPLTPEQISSFYHVTSKESFWPILHNFPGLFSVDNSDWATFEEVNRSFARAACEEAAPGATIWIHDYNLWLTPAMIREQRQDVRIAFFHHTPFPSSDVFSILPWRDEILDSLLSCDLVGFHIPSYANNFARCAINLRGAEGADPVPVAKKFRRYGSALSEPTVVPWIDHNCRRVHIQASPVGTSPELIRDLVVTPAVKAMANTIAEQHEGRKLILSASRVDYTKGNEEMLLAYERLLEQQPRWHGGVELFLGCVAAASGMRIYEDIQRSVEEIVGRINGRFGRIDWTPVRLSTHRTSYEELMGWFSQADVCWITPLRDGLNLVAKEYVAARQGLGGVLVLSEFTGASVELEDAVLTNPYSHRSMDRAISDALDMPQEEQVQRMASMTQAVDEFTVQHWAEQQLGTLRSL

SEQ ID NO: 748 - protein, 486 aa, Oryza sativa
  misc_feature (102)..(102): Xaa can be any naturally occurring amino acid
  misc_feature (123)..(123): Xaa can be any naturally occurring amino acid
MFGGGGGGGRKPLDYEELNENVKKVQYAVRGELYLRASELQKEGKKIIFTNVGNPHALGQKPLTFPRQVVALCQAPFLLDDPNVGLIFPADAIARAKHYLAXMAPGGLGAYSDSRGIPGIRKXVAEFIERRDGYPSDPELIYLTDGASKGVMQMLNTIIRNERDGILVPVPQYPLYSAAISLFGGSLVPYYLEEEANWGLDFVNLRQTVASARSKGITVRAMVIINPGNPTGQCLSEGNIKELLKFCFHENLVLLADEVYQQNIYQDERPFISARKVLFDMGPPMSREVQLVSFHTVSKGYWGECGQRGGYFEMTNLPPKTVDEIYKVASIALSPNVPGQIFMGLMVNPPKPGDISYLKFSAESKSILESLRRRARLMTDGFNSCRNVVCNFTEGAMYSFPQIRLPPKAIDAAKRAGKAADVFYCLKLLEATGISTVPGSGFGQKEGVFHLRTTILPAEEDMPAIMTSFKKFNDTFMDQYDGYSRM

SEQ ID NO: 749 - protein, 511 aa, Haloarcula marismortui ATCC 43049
MTCYAMSLRQRSTTASRRGSPYQRQMGPGVSGNAQNDAVPDSLVVVSNREPYSHEQDDDGEIQVQSAAGGLTSALDPVMQSRGGTWVAWGSGDADMAVADEGIVEVPPSDPAYDLKRVPLSDAAVQGYYYGYANQVLWPLCHEDTGRIWAEPAYWEQYRAVNEQFAEAVDTVADAGQPVWFQDYHLALAPRLVRERRPDATLLQFWHIPWPAPSVFRHCPHSDALLDGLLACDIIGFHTAGYAEQFLHCVDSAFPAATVDTDSGTVTRDGDRTRAVANPLGIDVGGVRDRARATDVASIRDTVLGGSRSDTSIRLALGVERLDYSKGIPERIEALAHLWDRRPDLRGDFTYVQKASRTREGIAAYRRYRADVVDAIERVNDRFGTDDWQPIVYTEANLDNETLAGLYRAAEVAVVTPHRDGMNLVAHEYPVACTDGDGALVLSELAGAATHLDGALTVNPHDIEAIADAIERALELDEAETSDRLSRLQHSVETLDSAEWVARQFSAGQSL

SEQ ID NO: 750 - protein, 495 aa, Saccharomyces cerevisiae
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHMMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 751 - protein, 384 aa, Staphylococcus aureus subsp. aureus Mu50
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPIFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 752 - protein, 86 aa, Arabidopsis thaliana
  misc_feature (58)..(58): Xaa can be any naturally occurring amino acid
  misc_feature (74)..(74): Xaa can be any naturally occurring amino acid
MARLREGGTFYSPEAFLEAWQEKKGAKKELFFQQNVGEPFMPLGQKPLTFPRQVVALXQAPFILDDPNVGMLFXADAIARAKHYLS

SEQ ID NO: 753 - protein, 518 aa, Polyporus ciliatus
MARFQSLLSFVTLLFAVSAYAAIGPVTDLTVTDANISPDGFNRAAVVVNGVFPAPLITGQKGDRFQLNLVNQMTNHTMLKTTSIHWHGFFQKGTNWADGPAFVNQCPIASGNSFLYDFQVPDQAGTFWYHSHLSTQYCDGLRGPFVVYDPADPHLGLYDVDDDSTVITLADWYHVAAKLGPRFPPSSDSNLINGLGRSPSTPTADLAVISVTQGKRYRFRLVSISCDPNYTFSIDGHQLTVIEADGISTQPVTGIDSIQIFAAQRYSFVLTADQPVDNYWVRANPNFGNTGFAGGINSAILRYDGAPAIEPTTNQTGTNLLLETDLHPFTPTPVPGNPTQGGADFNLNLAFNFNGTDFSINGATFTPPSVPVLLQIISGANSAQDLLPSGSVYALPSNSSIELTFPATAAAPGAPHPFHLHGHAFAVVRSAGSTVYNYDNPVYRDVVSTGTPGDNVTIRFQTDNPGPWFLHCHIDFHLDAGFAVVFAEDIPDVASANPVPQAWFDLCPIYNALDPSDQ

SEQ ID NO: 754 - protein, 227 aa, Aspergillus nidulans FGSC A4
MFDYDGTLTPIVKDPQSAIPSDRVLRTLKTLAADPRNAVWIISGRDQAFLDEWMGHIPELGLSAEHGCFIRMPRSDNWQNLAETTDMGWQKEVMEIYQHFTERTQGSFIERKKVALTWHYRRADPEYGAFQARECRKQLEEHVSKTWDVEVMAGKANLEVRPRFVNKGFIATRLVQAYEDGKVPEFILCSGDDFTDEGMLFPFLATPKLRHELLLTYLRYVPCLEEI

SEQ ID NO: 755 - protein, 473 aa, Burkholderia vietnamiensis G4
MSRLIVVSNRVAAGEDTRPSAGGLAVGVMDALKQTGGVWFGWNGEIVGTPDAAPAVRRDGNVTYATLGLTRRDYDQYYRGFSNATLWPVFHYRSDLARFDRQEYAGYLRVNAMLARQLAALLRPDDLIWVHDYHLLPFAHCLRELGVKNPIGFFLHIPFPSPDMLRVVPPHDELVKFMCAYDIAGFQTDADKRAFSDYIERRGIGTASDDGMLHAHGRVVKVAAYPIGVYPDAIAEAAVQYGGRKPVKMLRDALGGRKLVMSVDRLDYSKGLVERFQSFERMLAGAPDWQGRVSFVQIAPPTRSDVQTYQRIRETLEREAGRINGRFAQLDWTPIQYLNRKYERNLLMAFFRMSQVGYVTPLRDGMNLVAKEYVASQDPADPGVLVLSEFAGAAAELGGALLVNPYDHAQMADALARALAMPLAERQARHEENLAQLRNNDLSVWRDTFVADLRSVAAAASVTQRAGRRTAHV

SEQ ID NO: 756 - protein, 524 aa, Polyporus ciliatus
MSKFQSLVAFVALTLATSRLAAAAIGPVADLTITNADINPDGFTRAAVLANNVFPGPLITGNKGDNFQLNVVDNLSNDTMLTATTIHWHGFFQKGTNWADGPAFVNQCPISTGNSFLYNFNAPDQAGTFWYHSHLSTQYCDGLRGPMVVYDDADPHASLYDVDDESTVITLADWYHTAARLGPCFPLGSDSTLINGLGRFAGGDADAPLTVISVTSGKRYRFRLISISCDPNFTFTIQGHTMTVIEVDAVNVQPYEVDSIQIFAGQRYSFVLTADQAVDNYWIQAIPSIGTITTDGGVNSAILRYDGADIVEPAAATVTGSNPLVETSLVPLENLAAPGEPTIGGVDYPLNLDFSFDGTNFAINGATFTPPTVPVLLQIMSGAQDVADLLPSGSIYSLPSNATIELSFPITATNAPGAPHPFHLHGHTFYVVRSAGSTEYNYVNPPQRDTVSTGTAGDNVTIRFTTNNPGPWFLHCHIDFHLEAGFAVVFGEDIPSISDANPPSSAWEDLCPTYNSVYPNGDGN

SEQ ID NO: 757 - protein, 477 aa, Polyporus ciliatus
AVVVNGQFPGPLVTGNKGDNFQINVIDQLTNNTMLKSTTVHWHGFFQKGTNWADGPAFVNQCPISTGNSFLYDFTAADQAGTFWYHSHLSTQYCDGLRGPMVVYDPNDPHASLYDVDDESTVITLSDWYHTAAKLGPAFPLGPDSVLINGLGRFAGGDANADLAVISVTQGKRYRFRLVSISCDPNFVFSIDKHNMTVIEADAVSHEPVTVDSIQIYAGQRYSFVLTADQAIDNYWIRALPSGGTVNFDGGVNSAILRYDGAAEIEPVTNRTMSMAPLVESDLVPLDNPAAPGDASIGGVDYALNMAFSFNGTNFFVNGATFVPPTVPVLLQIMSGAQSATDLLPGGSVYSLPSNATIELSFPITATNAPGAPHPFHLHGHVFSVVRSAGSSEYNYVNPPRRDVVNTGTAGDNVTIRFTTDNPGPWFLHCHIDFHLEAGFAVVFSEDSSSGGDSDLSSNDAWNNLCPTYDALSADDL

SEQ ID NO: 758 - protein, 404 aa, Streptococcus pneumoniae R6
MKEYNKSSKLEHVAYDIRGPVLEEAMRMRANGEKILRLNTGNPAEFGFTAPDEVIHDLIMNARDSEGYSDSKGIFSARKAIMQYCQLKKFPNVDIDDIYLGNGVSELIVMSMQGLLDNGDEVLVPMPDYPLWTAAVSLAGGNAVHYICDEAVEWYPDIDDIKSKITSNTKAIVLINPNNPTGALYPKELLLEIIEIARQNDLIIFADEIYDRMVMDGHVHTPVASLAPDVFCVSMNGLSKSHRIAGFRVGWMVLSGPKTHVKGYIEGLNMLSNMRLCSNVLAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 759 - protein, 488 aa, Oryza sativa
  misc_feature (78)..(78): Xaa can be any naturally occurring amino acid
  misc_feature (281)..(281): Xaa can be any naturally occurring amino acid
  misc_feature (330)..(330): Xaa can be any naturally occurring amino acid
  misc_feature (366)..(366): Xaa can be any naturally occurring amino acid
MFGGGGGGGRKPLDYEELNENVKKVQYAVRGELYLRASELQKEGKKIIFTNVGNPHALGQKPLTFPRQVVALWQAPFXLLDDPNVGLIFPADAIARAKHYLAMAPGGLGAYSDSRGIPGIRKEVAEFIERRDGYPSDPELIYLTDGASKGVMQMLNTIIRNERDGILVPVPQYPLYSAAISLFGGSLVPYYLEEEANWGLDFVNLRQTVASARSKGITVRAMVIINPGNPTGQCLSEGNIKELLKFCFHENLVLLADEVYQQNIYQDERPFISARKVLFEXGPPMSREVQLVSFHTVSKGYWGECGQRGGYFEMTNLPPKTVDEIYKVAXSIALSPNVPGQIFMGLMVNPPKPGDISYLKFSAESXKSILESLRRRARLMTDGFNSCRNVVCNFTEGAMYSFPQIRLPPKAIDAAKRAGKAADVFYCLKLLEATGISTVPGSGFGQKEGVFHLRTTILPAEEDMPAIMTSFKKFNDTFMDQYDGYSRM

SEQ ID NO: 760 - protein, 201 aa, Brassica napus
  misc_feature (195)..(195): Xaa can be any naturally occurring amino acid
KAKNLIDQTHQARHKSLRLLSLLAASDSAPVLSSPRLFSSSSDMSGSGSDSSSSSLPVTLDSLNPKVLKCEYAVRGEIVNIAQKLQEDLKINKDAYPFDEIIYCNIGNPQSLGQQPITFFREVLALCSHTALLDESATHGLFSSDSIERAWKILDQIPGKATGAYSHSQGIKGLRDAIAAGIEARDGFPADPNDXFMTDGA

SEQ ID NO: 761 - protein, 482 aa, Escherichia coli
MSRLVVVSNRIAPPDEHAASAGGLAVGILGALKAAGGLWFGWSGETGNEDQPLKKVKKGNITWASFNLSEQDLDEYYNQFSNAVLWPAFHYRLDLVQFQRPAWDGYLRVNALLADKLLPLLQDDDIIWIHDYHLLPFAHELRKRGVNNRIGFFLHIPFPTPEIFNALPTYDTLLEQLCDYDLLGFQTENDRLAFLDCLSNLTRVTTRSAKSHTAWGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLMKIFRYSDVGLVTPLRDGMNLVAKEYVAAQDPANPGVLVLSQFAGAANELTSALIVNPYDRDEVAAALDRALTMSLAERISRHAEMLDVIVKNDINHWQECFISDLKQIVPRSAESQQRDKVATFPKLALEHHHHHH

SEQ ID NO: 762 - protein, 175 aa, Vibrio angustum S14
MASVGLFFGSDTGNTEAVAKMIQKQLGDKLVEVKDIAKSSKEDIDNFDLLLLGIPTWYYGEPQCDWDDFFPELEQIDFSTKLVAIFGCGDQEDYAEYFCDSMGTVRDIVESRGATIVGNFSTEGFEFEASKALVDDNHFVGLCIDEDRQPELTAQRVKQWVEQIYDEMCLAELAD

SEQ ID NO: 763 - protein, 397 aa, Bacillus pumilus SAFR-032
MKKSYLSETVQSIQPSGIRKFFDLAATMEGVISLGVGEPDFVTAWNVREASIMSLEQGLTSYTANAGLLSLRKELSDYLYKRFHIDYSPEEELIITVGGSQALDLAFRAILNSGDEVIIPEPCFVAYGALTTLAGGVPVYLSTSAEKDFKADSADLRTKLTPKTKAILLCSPSNPTGSVYSKEELEDIAQFAKEHDLLVITDEIYAELTYDEAFTSVAAIQDMKERTILISGFSKGFAMTGWRLGYVAAPPVLRDAMLKIHQYSMMCAPAMAQYAAEEALKNGLEDVEKMKKSYRRRRNLFVGSLNELGLACHQPNGAFYAFPSIKSTGMTSEQFAEELLLSEKVAVVPGNVFGPSGEGHIRCSYASSLDHLQESLSRIQRFLQERQVKAEAPVIIK

SEQ ID NO: 764 - protein, 229 aa, Zea mays
MAPSVAVENLNPKVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDAIAAGITSRDGFPANADDIFITDGASPGVHMMMQLLIRNEKDGILCPIPQYPLYSASIALHGGALVPYYLDEKTGWGLEISDLKKQLEDARSKGIDVRALVVINPG

SEQ ID NO: 765 - protein, 189 aa, Musa acuminata AAA Group
GLRVQAIANFQDYHGLPTFRKAIAQFMEKVRGGRARFDPDRIVMSGGATGAQETIAFCLADPGEAFLIPTPYYPGFDRDFRWRTGVQLLPIHCHSSNKFKITQAALETAYRKARNSHIRVKGILVTNPSNPLGTTMDRETLRTLVSFVNEKRMHLVCDEIFSGTVFDKPSYVSVSEVIEDEPYCDRDLI

SEQ ID NO: 766 - protein, 510 aa, Frankia sp. CcI3
MSDFNPLDLSLDLPLVLLSNRGPVRFDRDATGRTVTRGAGGLVSALSGLAEHLDDAVWVCGAASEEDVAVAGESAGSSILVQTYPSPRLVEGDPDGPAIRVRLVVTDPTAYADFYSVWSNPVLWFIQHGLYGRSLSPVFTRAEHDAFENGYAAVNRAYADAVVDEVRARGGKALVLLQDYHFYLVADWVREQCPDAVLTHFIHIPWPGPDEWRILPADIRERLLRGLLGSDVVGFHTRRYARNFVLCAQELLGLPIDLEQLTVTVADRVVRARYHPISVDPAALDATQASEEVAAHVAMLRYIFLDDDRQLILRVDRTDPSKNVVRGFLAFGTLLDQHPELVGKVSFLALLQPSRTDVPEYADYIALIGAVVAEINARHTKEGRQPIDLRMVEDFPLAVAAYSICDVLIVNAIADGMNLVAKEVAVVNRRGGVLALSEMAGAHEELGEFAVTLHPFDVQQMADALYTALTMPMEERHRRLAAAARQVRTHDVRRWLDDQLVDLRRVAGFG

SEQ ID NO: 767 - protein, 410 aa, Medicago truncatula
MNHECKATSTITIKGILSLLMESVGENNDDNSKRVISLGMGDPTLSTCFPNAKVAEEAVADALCSGNFHGYAPTAGLLQARNAIAKYLSDDLPYELSSDDVFITCGCTQAIDVSVALLSRPGANILLPRPGFPIYELCAAFRQVEVRHYDLLPEKGWEVDLDAIETLVDQNTVALVIINPGNPCGNVYTYHHLEKIAETAKRLGTIVIADEVYGHLAFGDNPFVPMGVFGSTVPVITLGSLSKRWIVPGWRLGWFVTNDPSGTFRKPKVVERIKKYFDLLGGPATFIQAAVPRIITQTEEVFFRKTIDKLRHTADICCQEMEDIPCISFPCKPQGSMAMMVELNLSLLEDISDDIDFCFKLAKEESVIILPGTAVGLKDWIRITFAADPSALRDGMQRIKSFSQRHARKQ

SEQ ID NO: 768 - protein, 374 aa, Methanothermobacter thermautotrophicus str. Delta H
MIMRKFASRVKDIQLSEIRKIFEVADEDTINLGIGEPDFSVPDHVREAVKDAVDEGLTHYTSNMGMEELREAIADKLKSENRVHAEPESIIVTVGASEAIFMCTQALLDIGDHALIPDPGFLSYDACVRLSGAVSIPVPLSMDEGFSMSPERVESLITQDTRVIIMNSPSNPTGSVMGKDDVKGIAEIAEDNDLIIISDEIYEKIIYDGKHYSPAQFTDNALIVNGFSKTYAMTGLRIGYVAGCEDIIEELLKVHQYNTACAPSISQYAALAAIRGPQNCVKDMVDEFRRRRDLMFRSLTDMGLECVLPGGAFYMFPYAGDSEEFTKLSLEAGVAVVPGSAFGNEGKGYIRMSYATSYELIEEAMERLKTVCGV

SEQ ID NO: 769 - protein, 398 aa, Pyrococcus furiosus DSM 3638
MIRASKRALSVEYAIRDVVLPARELEKKGIKVIRLNIGDPVKFDFQPPEHMKEAYCKAIKEGHNYYGDSEGLPELRKAIVEREKRKNGVDITPDDVRVTAAVTEALQLIFGALLDPGDEILVPGPSYPPYTGLVKFYGGKPVEYRTIEEEDWQPDIDDIRKKITDRTKAIAVINPNNPTGALYDKKTLEEILNIAGEYEIPVISDEIYDLMTYEGEHISPGSLTKDVPVIVMNGLSKVYFATGWRLGYMYFVDPENKLSEVREAIDRLARIRLCPNTPAQFAAIAGLTGPMDYLKEYMKKLKERRDYIYKRLNEIPGISTTKPQGAFYIFPKIEVGPWKNDKEFVLDVLHNAHVLFVHGSGFGEYGAGHFRAVFLPPIEILEEAMDRFEKFMKERLKE

SEQ ID NO: 770 - protein, 387 aa, Candidatus Pelagibacter ubique HTCC1002
MKLAKNLQRLGTESAFSVLAEAKKLEAQGKPMIHLGLGQPDFKTPQHVVDAAKKALDEGHHGYVLSNGILECRQAVTRKIKKLYNKDIDPERVLIMPGGKPTMYYAIQCFGEPGAEIIHPTPAFPIYESMINYTGSTPVPYDLTEDKDLKFDPEKILSLITDKTRLLILINPNNPTGSFVEKSAIDVLAEGLKKHPHVAILSDEIYSRQIYDGKEMPTFFNYPDLQDRLIVLDGWSKAYAMTGWRMGWSVWPEELIPHVNKLIINSVSCVNAPSQFAGIAALDGPDDAIHEMMVKFDQRRKLIHEGLNSLPGVECSLPGGAFYAFPKVIGTGMNGSEFAKKCMHEAGVAIVPGTAFGKTCQDYVRFSFAASQDNISNALENIKKMLG

SEQ ID NO: 771 - protein, 520 aa, Mesorhizobium loti MAFF303099
MQWSPETLRHILATELPDAQVIVVSNREPYIHNREGDDIQLVVPASGLVSALEPITRACAGTWIAYGGGSADKLVVDKNDRIEVPPDNPSYTLRRVWLSEEEQQGYYLGFANEGLWPLCHIAFTRPIFRASDWEAYEAVNRKFADTVVAEARNERPIVLVQDYHFALLPRMIRERLPEAIIITFWHIPWPNSEVFSICPWREKILDGLLGSSIVGFHTQFHCNNFIDSVDRFLESRIEREDSAISYGGQISLVHAYPISIEWPPAQLGKLPDVAQCRRQVREKFGLAENVKLCVGVERLDYTKGILDRFNALDELLTLHPEWIGKVAFLQIAAPSRGTLPAYQQLYEECLRHAEDLNQRYGREGYTPVLMITEHHSQQQVYEIYRAADVCMVTSLHDGMNLVAKEFVAAREDEQGVLLLSMFAGASKELLDALIVNPYDAAMMGDALLQALTMSQEEQSQRMRRMREIVRDNNVYRWAGSMLLDAARLRKRDAVDRAVSAAPAAPANVISLLDRRRVAAL

SEQ ID NO: 772 - protein, 338 aa, Zea mays
MRRFAADRARRAVAASLHGAASRSAAPSPHAPAPRHPASPVGSAAMAAAMVRTMSTTAAGTPPVSVATINPKVLKCEYAVRGEIVTHAQNLQQELQKNPESLPFDEILYCNIGNPQSLGQQPVTYFREVLSLCDHPALLDKSETHALYSSDAIERAWQILEKIPGRATGAYSHSQGIKGLRDEIAAGIAARDGFHASGDNIFLTDGASPAVHMMMQLLISSESDGILCPIPQYPLYSASIALHGGSLVPYFLNEETGWGLDVDELKKQLEEARSKGITVRALVVINPGNPTGQGLVEENQKKIVEFCKNEGLVLLADEVSQKSELVFEVFTITIRQYP

SEQ ID NO: 773 - protein, 406 aa, Pyrococcus furiosus DSM 3638
AHHHHHHGSIRASKRALSVEYAIRDVVLPARELEKKGIKVIRLNIGDPVKFDFQPPEHMKEAYCKAIKEGHNYYGDSEGLPELRKAIVEREKRKNGVDITPDDVRVTAAVTEALQLIFGALLDPGDEILVPGPSYPPYTGLVKFYGGKPVEYRTIEEEDWQPDIDDIRKKITDRTKAIAVINPNNPTGALYDKKTLEEILNIAGEYEIPVISDEIYDLMTYEGEHISPGSLTKDVPVIVMNGLSKVYFATGWRLGYMYFVDPENKLSEVREAIDRLARIRLCPNTPAQFAAIAGLTGPMDYLKEYMKKLKERRDYIYKRLNEIPGISTTKPQGAFYIFPKIEVGPWKNDKEFVLDVLHNAHVLFVHGSGFGEYGAGHFRAVFLPPIEILEEAMDRFEKFMKERLKE

SEQ ID NO: 774 - protein, 517 aa, Coriolopsis gallica
MLHTRTRLGNVLALLSLLGTAWGAIGPKTDLHIVNKVIAPDGFPRDTILAGGTFPGPLITGKTGDRFLIDVYDDLTNTTMLTPTSIHWHGLFQHTTNWADGPAFVTQCPISSGHNFLYNFRVPDQSGTYWYHSHFGLQYCDGLRGPIVVYDPHDPQKHLYDVDDDSTVITLSDWYHVAAASVPVPPQSDSTLINGLGRWGGDPTSELAVITVEHGKRYRFRLASLSCDPFFTFSIDGHDMTIIEADGVNTQPLKVDQLDIFAAQRYSFVLEANQPKGNYWMRANPNHANFVGFENGINSAILRYKGAPVAEPNTTQTPSKKPLLETNLHPLTKQAVPGKPHPGGADVNINLELGVDVNAGLFLVNGSPFIPPDIPVLLQILSGNYSAQSLLPPGVVYTLPPNQSVELSIPGGVLGGPHPFHLHGHAFSVVRSAGSSVYNYKNPVQRDTVSIGDSTDNVTIRFFTDNPGPWFLHCHIDFHLNAGLAVVFAEDPKDTAFVNPVPSSWKELCPTYYAENP

SEQ ID NO: 775 - protein, 526 aa, Coprinopsis cinerea okayama7#130
MSFAWKALATLAVAIASRSAFAQSIIGNQDTMTISNINAGPDGFTRPVIAVNGEFPSPLVRANKGDDFRINVVNNLDDDTMLRQTSVHWHGVFQHQSAWADGPDGVTQCPIPQSGQEFEYAFNAGQEAGTFWYHSHYGTQYCDGLRGPLVIYDPEDPHQDLYDVDDENTIITLADWYHLQAPSIQGPAVSQATLINGKGRRPGNTEGDIAVVNVEKDSRYRFRIVSLSCDPDYTFSIDNHTMTIIEADGQNTKPLEVESIRVFAGQRYSVVVNADQAIGNYWIRAEPNIGDTGLVGTSGGGVNSAILRYATADEVEPDTPRLTNRPALQESNLRALTSGVPGGDGPADITFTFNLGLNFATGTFSMNPGESWVHPDTPVMVQIMNGVPAEDLVPAESLHTITRGQVVEVVIPPFGIAGPHAFSVIKSAGGSPNFVDPVRRDVVAVGTEAGQGDTIIRFVADNPGPWFFHCHIEFHLVTGLAAVFMEAPDEIASSNPPPPSWDALCPAFSALPPSATSIRIVPTPTP

SEQ ID NO: 776 - protein, 500 aa, Mycobacterium tuberculosis H37Rv
MAPSGGQEAQICDSETFGDSDFVVVANRLPVDLERLPDGSTTWKRSPGGLVTALEPVLRRRRGAWVGWPGVNDDGAEPDLHVLDGPIIQDELELHPVRLSTTDIAQYYEGFSNATLWPLYHDVIVKPLYHREWWDRYVDVNQRFAEAASRAAAHGATVWVQDYQLQLVPKMLRMLRPDLTIGFFLHIPFPPVELFMQMPWRTEIIQGLLGADLVGFHLPGGAQNFLILSRRLVGTDTSRGTVGVRSRFGAAVLGSRTIRVGAFPISVDSGALDHAARDRNIRRRAREIRTELGNPRKILLGVDRLDYTKGIDVRLKAFSELLAEGRVKRDDTVVVQLATPSRERVESYQTLRNDIERQVGHINGEYGEVGHPVVHYLHRPAPRDELIAFFVASDVMLVTPLRDGMNLVAKEYVACRSDLGGALVLSEFTGAAAELRHAYLVNPHDLEGVKDGIEEALNQTEEAGRRRMRSLRRQVLAHDVDRWAQSFLDALAGAHPRGQG

SEQ ID NO: 777 - protein, 537 aa, Triticum aestivum
HIGRSSRFRSSQRILLPFGSANVAAAMAMANPSAAGAPGICSDALFRELWHACAGPLITVPRQGERVYYFPQGHMEQLEASTNQQLDQYLPMFNLPSKILCSVVNVELRTEADSDEVYAQIMLQPEANQGELTSLGPEPQELEKGTIHSFCKTLTASDTSTHGGFSVLRRHAEECLPPLDMSQNPPCQELVAKDLHGTDWHFRHIFRGQPRRHLLTTGWSVFVSSKRLVAGDAFIFLRGENGELRVGVRRHMRQVNNMPSSVISSHSMHLGVLATASHAISTGTLFSVFYKPRTSQSEFVVSVNKYLEAKKQNISVGMRFKMKFEGDEALERRFSGTIIGIGSTPMVSTSLWADSDWKSLKVQWDEPSSILRPDRVSPWELEPLDAANPQPPQPPLRNKRPRLPASSSVVPELAPKFGLWKSPAEPSQTLSFSEPQQARGLFTNSRFSSSSNVAFNQFYWPARESREDSYAGSTNKVTVERKLEPTAGGCRLFGIEIRSAVEETQPVLTVSGDGYDQTAASVDVDSGELSQPSNINN

SEQ ID NO: 778 - protein, 868 aa, Ginkgo biloba
MMSRSYTNLMDLATGNFPAFGRATKRLPRVMTVPGIISELDDDNSNSVSSDVPSSICQERMIIVANQLPLRAQRRPDNRGWAFSWDEDSLLLQLKDGLAEDMEVVYVGSLKVEVDLSEQDDVAQILLENFKCVPAFLPPELLTKFYHGFCKQQLWPLFHYMLPLSPDHGGRFDRSLWQAYVSANKIFADKVMEVISPDDDYVWVHDYHLMVLPTFLRKRSNRVKLGFFLHSPFPSSEIYRTLPVRDEILRALLNSDLIGFHTFDYARHFLSCCSRMLGLEYESKRGYIGLEYYGRTVGIKILPVGIHMGQLESVLNLADTEWRVGELRDQFKGKILLLGVDDMDIFKGISLKFLAMEQLLKLHPEWRGKVVLVQIANPARGRGKDVEDVQAETHSTAKRINETFGRPGYEPVVLIDRPVPFYERIAFYTIAECYVITAVRDGMNLTPYEYIVCRQGSPRLNETLGVSPNVSKKSMLVVSEFIGCSPSLSGAIRVNPWNIDAVAEAMSTAITMPETEKQLRHEKHYRYVSTHDVGYWAHSFMQDLERACKDHFRRRCWGIGFGLGFRVVALDPNFRKLSTEHIVSAYKRTKSRAILLDYDGTMMPQTSINKTPGSEVLFILNSLCSDPKNVVFIVSGRGRQTLSQWLSPCEMLGIAAEHGYFIRWTRDAEWETCVQGVDFGWKQITEPVMKLYTETTDGSVIETKESALVWHHQDADPDFGSCQAKELLDHLESVLANEPVVVKSGQHIVEVKPQGVSKGLVAERLLSIMVQNDKRPDFVMCIGDDRSDEDMFEGITSAMAGPSLSPIAEVFACTVGQKPSKAKYYLDDTVEVLRMLQGLAAASDQTAKTSSDQAAKNPSAQVALECSL

SEQ ID NO: 779 - protein, 768 aa, Stenotrophomonas rhizophila
MSPLTVSTPSLSTPTRTPPATPAPQLILATDLDGTFLAGDAAARHRLYRLVDQHPGIALIFITGRGLEAVMPLLSDPAIPRPDYVVCDVGATVVDGHTLQPLQPLQSMIDAHWPGEHVVAAAMRPFTALQRQDVPQERRCSYFCDPQTLAPLRAQIQAAAQALGCDVLYSADRYLDILPPDTDKGRTLAALARLLDLPRERILVAGDTLNDLSMYTAGFRGVCVGDSEPALTEATATLATTFHAQAPGCGGILEAIEHFALLADDDRYLYPPKQARAAGADLVMVYHRLPFDEVMENGVLVQRPPRSPNGIIPSLLSFFEGGQKGSWVAWGIDDPKRGPFQTHLAVDAERYPTLTAARVPLSRQEVDIFYKRFSKEAYWPMLHVFWERARFREDDWQVFLKVNRKFAEATAAEAAHGATVWIHDYNLWMVPATLRELRPDLKIAFFHHTYFPSADVFNVVPWRREIIGSLLSCDYIGFHIPRQVENFVDVVRGAVPAERLAWESCAPRFLTYGCAVGLDTMTTRLRVGDREIALGAHPVGTDLRRIHNVLARSDVRNDIFKLRREIGARKLVLSVERLDYTKGTLAKLEAFERLLEQHPERQGKVTLLMVCVPAAREMTVYRTLQNQIEQAVGRINGRFSRLDWTPVRFFAQALPFEEVVAHYAAAQVMWITPLRDGMNLVAKEFVATHGIEGSSGVLVLSEFAGAAAELKGAVLTNPHDPADLTAGLLQALSMPEEEATGRMRQLFGSVEYYDVDRWGREFLEAVRG

SEQ ID NO: 780 - protein, 128 aa, Brassica napus
  misc_feature (120)..(120): Xaa can be any naturally occurring amino acid
DFDKQLRHKKHYHYISTHDVAYWSRSFIQDLERACRDHYSKRCWGVGWGLGFKLIALSPNFRRLSIEQTVSAYRRSSKRAIFLDYDGTLVPEASIVKEPSADVISALKTLCTDPDNTAFXVIGRGKVS

SEQ ID NO: 781 - protein, 719 aa, Triticum aestivum
  misc_feature (209)..(209): Xaa can be any naturally occurring amino acid
QSPNESGASAGGRVERASWEAYVLANKHFFEKIVEVINPEDDYVWVHDYHLMALPTFLRRRFNRLRIGFFLHSPFPSSEIYRSLPVREEILRTMLNCDLIGFHTFDYARHFLSCCSRMLGIEYQSKRGYIGLDYYGRTVGIKIMPVGIHMGQLQSVLRLPEMQQKVAELRQQFEGKTVLLGVDDTDIFKGINLKLLAFEYMLKTHPKWXGRAVLVQIANPARGKGKDIESIRAEIQDSCERINREFGQSGYSPIVLIDRNVPSVEKLAYYTVAECVVVTAVRDGMNLTPYEYIVCRQGIPSSESAPEVSGPRKSMLVVSEFIGCSPSLSGAIRINPWNVESTAESLNEAISMSERDKELRHEKHYRYVSTHDVAYWSRSFIQDLERACKDHFRKPCWGIGLGFGFRVVALDPNFSKLSFDSIIMSYGRSKSRAIFLDYDGTLVPQASLYQKPSEELVSIINTLCSDKNNIVFIVSGRSKNSLGSMFSSCPILGIAAEHGYFLRWTRDEEWQTSTQSPDIGWMQMAEPVMNLYTEATDGSYIETKETALVWHHRDADQGFASSQAKEMLDHLESVLANEAVSVKSGQFIVEVKPQGVSKGLIAEKILASMKEKGQQADFVLCIGDDRSDEDMFENIADAMKKGIVAPKTPLFACTVGQKPSKAKFYLDDTYEVVSMLSALAEVSEPDPTAGLTDDLATSVSSLDIGDEQIQFSNTRIEGS

SEQ ID NO: 782 - protein, 817 aa, Schizosaccharomyces pombe
MSVYGKIPSTSFEHENTFELSGDLLDPEELKSLGVSGRIIYVLRHLPFKSSINEETREWDLSGRRGATTMYSSMNWLANSTYWQTTLVGWTGVIPTVSEKEENKDAVTRLDSQDVKRFEETYSQWNSGERSTEYVPVWLPGPEKGSETIINETRSQQSRWLAYAENVIRPLIHYKYWPSSEVDENEEQWWRDYVKMNHAFADKICEIYKPGDFIIVQDYSLFLVPQLIRNKIDDAVIGFYHHHPFPSSEIARCFPRRRAILRSVLGADFIGFEDYSYARHFISCCSRVLDLEIGHDWVNLNGNKVTVRAITVGIDVPRIIRSSGNVSVSEKLEELNKRYENMKVILGRDRLDELYGVPQKLRSFQRFLRTYPEWRKKVVLIQITISSAFKHPKLLSSIKKLVQAINQEFGTDDYTPVHHVEEQLEPADYFALLTRADALFINSIREGVSNLALEYVVCQRDRYGMVLLSEFTATSAMLHDVPLINPWDYNECAEIISNALSTPLERRKMIERESYKQVTTHTMQSWTSSLIRSLANKLAATKTDQRIPTLTPEHALSVYSKASKRLFMMDYDGTLTPIVRDPNAAVPSKKLLDNLATLAADPKNQVWIISGRDQQFLRNWMDDIKGLGLSAEHGSFVRKPHSTTWINLAELLDMSWKKEVRRIFQYYTDRTQGSSIEEKRCAMTWHYRKADPENGAFQALECEALLEELVCSKYDVEIMRGKANLEVRPSSINKGGIVKQILSSYPEDSLPSFIFCAGDDRTDEDMFRSLHKNTRINKETSFAVTIGSDKKLSIADWCIADPANVIDILADLANFTN

SEQ ID NO: 783 - protein, 420 aa, Rhodococcus sp. RHA1
MTLVSNPDHGHHRKPHRKLEQSTKLQNVLYEIRGPVHAHAARLEAEGHRILKLNIGNPAPFGFDAPDVIMRDMIAALPYAQGYSESKGILSARRAIVTRYELVAGFPELDVDDIYLGNGVSELITMTMQALLDNGDEVLIPAPDYPLWTAMTSLAGGTPVHYLCDEGNDWNPDIADIESKITDKTKALLVINPNNPTGAVYSMEVLQQLVDLARKHQLLLLADEIYDKILYDDAKHISLATLAPDLLCLTFNGLSKAYRVAGYRSGWVAITGPKEHAAGFLEGLDLLASTRLCPNVPGQHAIQVALGGHQSIEDLILPGGRLLEQRDVAWERLNMIPGVSCVKPKGALYAFPRLDPNVYEIYDDEKLVQDLLLQEKILMVQGTGFNWPDHDHLRIVTLPWARDLAVAIERFGNFLTSYKQ

SEQ ID NO: 784 - protein, 586 aa, Neurospora crassa
MMWSLLVSLALLCFGTVARAAVVTINWNVTWVWASPDGFGRPVIGINNQWPCPKLEANVGDTLIVNLHNGLGNQTTGIHWHGINQLQTPEMDGPSGVVQCPTPPGSSVQYKFVLDEPGTFWYHSHEKGQYPDGLRGPLIVQDPNDPYKGRYDEEIVLTVSDWYHSQSIPLVQNMLSPANTRFAPPFPDTILLNDKKDVKFNFVKGKTYRVRLINMSAFASAFLWIDSHPLTMIMSDSTYLQTETAYQLHASSAQRYDFLISAIDRDSGNYPILVALDINRDFRNQTLAPAFPHNQTAWLMMDENAPLTRPTNTIDVWRPADDTHFKPLDNLAMVPAYDHLVKLDFRFCLDANGYPRACLNGKPFISQKVPSLYTAATVGGNNTNPLVYGQINPVVVRKGDIVQLVINNQEAAGHPFHLHGHSFQILDRARPYAGDWPGRDVNYNPVPNRRDTVTVWSWSHAVLRFRADNPGVWLFHCHIEWHVEMGLTASFIEGPEQLRGKQFPADHLENCRVGGVPTRGNAAGNELDPLDTTGMLTISPTGYTGATWIPPPANTVSMTPGNSTSPLARRRAASRVQRRDTVFENS

SEQ ID NO: 785 - protein, 424 aa, Mycobacterium smegmatis str. MC2 155
MERVTTHQLPWQSTGEHRKPRTFTQSTKLQDVLYEIRGPVHEHASRLEAEGHRILKLNIGNPAPFGFEAPDVIMRDIIQALPTAQGYSDSKGILSARRAVFTRYELVEGFPKFDVDDVYLGNGVSELITMTLQALLDNGDQVLIPAPDYPLWTASTSLAGGTPVHYLCDETQGWNPDVADIESKITERTKAIVVINPNNPTGAVYSRETLEQIVDLARKHQLLLLADEIYDKILYDDAKHISLATLAPDLLCLTFNGLSKAYRVAGYRSGWLVITGPKEHATSFIEGISLLANMRLCPNVPAQHAIQVALGGHQSIDALVLPGGRLLEQRDVAWEKLNEIPGVSCVKPRGALYAFPRLDPEVYDIHDDEQLVLDLLLQEKILLTQGTGFNWPTPDHLRIVTLPWARDLASAIERLGNFLASYRQ

SEQ ID NO: 786 - protein, 464 aa, Ralstonia metallidurans CH34
MGRLVAVSNRVADPRNHAAGGLAVALSDTLNKTGGLWFGWSGKVVDASRGGTPGEGELHQIQAGNVTLATVDLSREDFESYYLGYSNGVLWPVFHYRVDLADFDSGGNLNAYRRVNQLFARKLAPLLKPDDVIWIHDYHLIPLAAELRAIGCGQRIGFFLHIPLPPRLILATIPQHEWLMRALFAYDLLGFQSHDDVEHFSRYVQGEAGAEPMGEYRFRAFHRTVRAQAFPIGIDVDEFIELGRADEARETYEMMRGQYARRRLLLGIDRLDYSKGLPQRLKAFQTLLAEYPENRSSATLIQIAAPSRESVDAYADLRRDMEGITGAINGEYGELDWMPVRYIHRSTARRRLPGLCRACNVALVTPLRDGMNLVAKEYIAAQDPEDPGVLVLSRFAGAAEQLKEALLVNPYDTRATAQAIQQALHMSLSERQARHQKLLERIRQQDVHWWSGEYLRALMETEGG

SEQ ID NO: 787 - protein, 198 aa, Striga asiatica
KSTPCTARCSKIKPVMPSMPAFNDTPTATAFTTSFRSPNRAPVPTNIDHSLFFTVGLGLFNCPPGASRSTCQGPNGTRFGASMNNVSFVLPSNFSLLQAHKQGIQGVFTSDFPGNPPVQFDYTGNVSRALWQPVRGTKVYRIKYGETVQVVLQGTSIFTAENHPIHLHGYDFYIVAEGFGNFNQGRDASKFNLVDPPL

SEQ ID NO: 788 - protein, 176 aa, Klebsiella pneumoniae subsp. pneumoniae MGH 78578
MAIIGIFFGSDTGNTENIAKMIQKQLGKDVADVHDIAKSSKEDLEAHDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTNERVEKWVKQVAEELHLEEIKNA

SEQ ID NO: 789 - protein, 486 aa, Musa acuminata
MRIYGEEHPNQQILSRIATNDGHGENSSYFDGWKAYEKDPFHLTDNPTGVIQMGLAENQLSLDLIRDWMKKNPQASICTEEGVSEFKAIANFQDYHGLPAFRKAIAQFMEKVRGGRARFDPDRIVMSGGATGAQETIAFCLADPGEAFLIPTPYYPGFDRDFRWRTGVQLLPIHCHSSNKFKITQAALETAYRKARNSHIRVKGILVTNPSNPLGTTMDRETLRTLVSFVNEKRMHLVCDEIFSGTVFDKPSYVSVSEVIEDDPYCDRDLIHIAYSLSKDLGVPGFRVGVIYSYNDAVVSCARKMSSFGLVSSQTQHLLASMLGDEEFTTSFLATSRTRLCGRRRVFTDGLKRVGIHCLDGNAGLFCWMDLRPLLKEATVEAELRLWRVIINDVKLNISPGSSFHCSEPGWFRVCFANMDDTAMKIALRRIESFVYRENDAAVQAKNKRRWDEALRLSLPRRRFEDPTIMTPHLMSPHSPLVQAAT

SEQ ID NO: 790 - protein, 460 aa, Polaromonas sp. JS666
MSRLVVVSNRVADPRKTAAGGLAVALGDALNATGGMWFGWSGTVIEGGAPGEGELHVQQAGNVKLATVDLSAEDHAGYYLGYSNGVLWPVFHYRIDLARFDAGNIRAYRRVNQLFARKLMTQLRPDDIIWVHDYHLIPLAAELRAMGATQRIGFFLHIPLPPQQVLAAIPQHEWLMRAMFAYDLLGFQSEADLQNFSHYVQAEAGAEDLGDNRFRAFNRTVRAGAFPIGIDVDEFAALTHAKEGHDMYERMKDEYSRRKLLLGVERLDYSKGLPQRLRAFKSLLEKYPENIRSATLIQIASPSREDMGTYTDLLQELESLCGAINGDFGELDWMPVRYMHRNVARKRLPGLYRVARVALVTPLRDGMNLVAKEFIAAQDPADPGVLVLSRFAGAAEQLKEALLVNPYDTDGTADTIQHALQMSLQERQGRHQRLLKNIREQDVHWWRKTFLDTLRDAGSD

SEQ ID NO: 791 - protein, 518 aa, Pycnoporus cinnabarinus
MSRFQSLLSFVLVSLAAVANAAIGPVADLTLTNAAVSPDGFSREAVVVNGITPAPLIAGQKGDRFQLNVIDNLTNHTMLKTTSIHWHGFFQHGTNWADGVSFVNQCPIASGHSFLYDFQVPDQAGTFWYHSHLSTQYCDGLRGPFVVYDPNDPQASLYDIDNDDTVITLADWYHVAAKLGPRFPLGADATLINGLGRSPGTTTADLAVIKVTQGKRYRFRLVSLSCDPNHTFSIDGHTMTVIEADSVNTQPLEVDSIQIFAAQRYSFVLDASQPVDNYWIRANPAFGNVGFAGGINSAILRYDGAPEVEPTTTQTTSTKPLNEADLHPLTPMPVPGRPEAGGVDKPLNMVFNFNGTNFFINNHSFVPPSVPVLLQILSGAQAAQDLVPDGSVYVLPSNSSIEISFPATANAPGTPHPFHLHGHTFAVVRSAGSSEYNYDNPIFRDVVSTGQPGDNVTIRFQTNNPGPWFLHCHIDFHLEAGFAVVLAEDTPDTAAVNPVPQSWSDLCPIYDALDPSDL

SEQ ID NO: 792 - protein, 403 aa, Streptomyces coelicolor A3(2)
MQVIQSTKLANVCYEIRGPVLEEAMRLEAAGHRILKLNTGNPAAFGFECPPEILEDILRNVSTAHGYGDAKGLLAARRAVVMHNQTLGIETDVEHVFIGNGVSELIVMAMQGLLDDGDEVLVPAPDYPLWTAAVSLSGGTAVHYRCDEQSDWMPDLADVERKITDRTKALVIINPNNPTGAVYDDAMLRGLTDIARRHNLLVCSDEIYDKILYDDATHTPTAAIAPDLLTLTFNGMSKAYRVAGYRVGWMSISGPRAHAESYIEGLTILANMRLCANMPGQHGVVAALSGRQTINELVLPGGRLREQRDAAHEALTSIPGVTCVKPKGALYLFPRLDPKVFKIKDDRRMVLDLLRQEKIMVVQGTGFNWPEPDHFRVVTLPTAADLREAVDRIGNFLDGYSQP

SEQ ID NO: 793 - protein, 630 aa, Debaryomyces hansenii CBS767
MKIISLLYCIVFALGIVAKTHTFHFNASYITANPDGVHERRVIAINNEWPIPTIRIKKNDRVEIYFTNLLENRNTSLHFHGLFQQESNSMDGAEMVTQCPIAPGSTFLYNFTVTEQAGTYWYHSHSGAQYSDGLRGMFIVEDDKEPPFQYDEETTLTVSDWYHMEYPDVMSNFLSRYNPTGAEPIPQNSLFNDTKNSTWHVKPDTTYLVRIVNMGMFTSQYLYIEDHTFTIVEIDGNLIEPVETDSLYIAVAQRISVLVHTKKSKATNYRFVNIMDEEMLDFLPDELLVISTNWVAYNDKDLPQSLKNGPNEFEKLTEKLNPVDDFGLKPLSREALLPDSDYQIQLNFTMDNLGNGVNYAFFNNISYVLPKVPTLMTVLSSGEHAGDTEIYGSNTNTFVLQHNEVVEIVLNNMDDGKHPFHLHGHIFQVISRSEAGEDAEDPIVYDPENPDHTNFPDFPMIRDTVMVNPNGFIVLRFKANNPGVWFFHCHVDWHLEQGLAITLVEAPFEIQKSQSLSSNHLDACTSANVSSKGNAAGRYGDSSDIWHDLSGENSQPEPLPAGFTMKGYIAFFICSFCAVFGIYSIYKYGMEDIKNDSNEAVVQKLYRILDSHGALDESEQSALFSVNSRE

SEQ ID NO: 794 - protein, 492 aa, Mycobacterium avium subsp. paratuberculosis K-10
MAPGGGRGSKTAGYGNSDFVVVANRLPVDQERLPDGSTAWKRSPGGLVTALEPLLRRQRGAWVGWPGIVDEDVDHEDDPIVQDDLELRPVKLSADDVAEYYEGFSNATLWPLYHDVIVKPIYHREWWDRYVAVNRRFAEATSRAAARGATVWVQDYQLQLVPAMLRELRPDLTIGFFLHIPFPPVELFMQLPWRTEIVKGLLGADLVGFHLTGGAQNFLFLSRRLIGANTSRGAVGMRSRYGEVELESRVVRVGAFPISIDSTALDQTARHRDIRRRAREIRAELGNPRKVLLGVDRLDYTKGIDVRLKAFSELLAEGRAKRDDTVLVQLATPSRERVDSYQQLRNDIERQVGHINGEYGEVGHPVVHYLHRPVPRNELIAFFVAADVMLVTPLRDGMNLVAKEYVACRSDLGGALVLSEFTGAAAELRQAYLVNPHDLEGVKDTVEAALNQSVEEGRRRMRSLRRQVLAHDVDRWARSFLDALAESGPRDG

SEQ ID NO: 795 - protein, 176 aa, Salmonella typhimurium LT2
MAITGIFFGSDTGNTENIAKMIQKQLGKDVADVHDIAKSSKEDLEGYDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTAERVEKWVKQVSAELHLDDILNA

SEQ ID NO: 796 - protein, 92 aa, Triticum aestivum
MMSRKALNYQELNENVKNVLHAVHGELYLRAFHLQKEGMTIIFTNVDNRHALHQNPLTLPRHVVALCHDLFLLDDPNVGLIFPADCIERANH

SEQ ID NO: 797 - protein, 622 aa, Arabidopsis thaliana; identical to SEQ ID NO: 39

SEQ ID NO: 798 - protein, 175 aa, Escherichia coli
AITGIFFGSDTGNTENIAKMIQKQLGKDVADVHDIAKSSKEDLEAYDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTAERVEKWVKQISEELHLDEILNA

SEQ ID NO: 799 - protein, 631 aa, Kluyveromyces lactis NRRL Y-1140
MKVSTHHFLPSLLVALWSWATVAQAATHTFNWTTGWGNYNVDGNFERPVITCNGEFPWPDLKVKRGDRIQVYLTNGFDDRNTSLHFHGLSQNGTNMMDGPEMITQCPIAPGDTMLYNFTIDDNDGTYWYHSHTGGQYQDGMKGTLVVEPEDSLPFDYDEEVVVQLAEWYYDNVDTLDRKFMNVYNPTGAEPIPQNLIINNTRNMTWNVEPDTTYLLRIVNTGGFVSQYFWIEDHDMTVVEVDGVYVEKNTTSMLYITVAQRYSVLIHTKNDTSKNYAIMQKFDDTMLDVIPNDLMLNATSYMMYDKDGEKPEQSYVDSIDDFLDDFYLTPLDKVELYEDPDYTITVDVVMDNLKNGVNYAFFNNLTFTAPKVPTLMTALSAGKDALNPLVYGTNTNAFVLKKDEIIEIVLNNNDTGKHPFHLHGHIFQLVDRERGYDDAIGEGPHPFDPEDHNPFPDYPMMRDTVYVNPQSSIVLRFKADNPGVWFFHCHIEWHLKQGLALLLIEAPEEMQNTESQQLTDNHKQVCENVGLSWEGNAAGNTNDFLDLVGQNVQVANIPDGFTAKGIVAMTFSCLAGVLGLISLSTYGLMGVKKSEEEIIRDLGMDPDAVEKVDVSDINSDEDSSRTSKNIE

SEQ ID NO: 800 - protein, 419 aa, Corynebacterium glutamicum ATCC 13032
MGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 801 - protein, 587 aa, Cucumis sativus
MAKVADKPFFPKPFLSFLVLSIIFGFGITLSEAGFPKIKHYKWDVEYMFWSPDCVENIVMGINGEFPGPTIRANAGDIVVVELTNKLHTEGVVIHWHGILQRGTPWADGTASISQCAINPGETFTYRFVVDKAGTYFYHGHLGMQRSAGLYGSLIVDPPEGRSEPFHYDEEINLLLSDWWHQSVHKQEVGLSSKPMRWIGEPQSILINGKGQFDCSIAAKYNQGLKQCELSGKEKCAPFILHVQPKKTYRIRIASTTALASLNFAIGNHELLVVEADGNYVQPFVTSDIDIYSGESYSVLITTDQNPLENYWVSIGVRARLPKTPPGLTLLNYLPNSASKLPISPPPETPHWEDFDRSKNFTFRIFAAMGSPKPPVRYNRRLFLLNTQNRINGFMKWAINNVSLALPPTPYLAAMKMRLNTAFNQNPPPETFPLNYDINNPPPNPETTTGNGVYKFNMGETVDVILQNANMLNPNMSEIHPWHLHGHDFWVLGYGEGKFYAPEDEKKLNLKNPPLRNTVVIFPYGWTAIRFVADNPGVWAFHCHIEPHLHMGMGVVFAEGVHMVGMIPPKALACGSTALVKNYPRLP

SEQ ID NO: 802 - protein, 177 aa, Vibrio campbellii AND4
MASVGIFFGSDTGNTEAVAKMIQKQLGKQLVHVQDIAKSSKEDIDNFDLLLLGIPTWYYGEAQCDWDDFFPELEQIDFSTKLVAIFGCGDQEDYAEYFCDAMGTVRDIVEAKGGTILGYTSTESYEFEASKGLVEGDDSQFVGLCIDEDRQPELTDERVKNWVKQIHEEMCLAELED

SEQ ID NO: 803 - protein, 169 aa, Anabaena sp.
SKKIGLFYGTQTGKTESVAEIIRDEFGNDVVTLHDVSQAEVTDLNDYQYLIIGCPTWNIGELQSDWEGLYSELDDVDFNGKLVAYFGTGDQIGYADNFQDAIGILEEKISQRGGKTVGYWSTDGYDFNDSKALRNGKFVGLALDEDNQSDLTDDRIKSWVAQLKSEFGL

SEQ ID NO: 804 - protein, 499 aa, Synechococcus sp. RS9917
MLKEEGKSSFILLYHRTPFDEGKDEQGKRIWIDQKSPNGIIPTLRNLFRSRLDGTWIAWRQVESTEGVEDERIAMKAPAEFTLRRIPLEQEQISSFYHVTSKESFWPILHTFPTYFDVNNTDWTIFQDVNRRFAQAACHEAGHGATVWVHDYNLWLAPGYIREQRPDLKIAFFHHTPFPGNDVFAILPWREQILESLLSCDLVGFHIPRYTENFARAANCLLGARKGPKQPVNARFLSTGSALTEPSETPWLDYKGRRIQLLSSPVGTSPDVIQALVNRDDIQDYAARIEDDTRKGRQLILSASRVDYTKGNEELLLAFERLLERRPELHGQVVLMLACVSAASGMKIYDDTQRSIEEMAGRINGRFSLMDWVPIRFSTRRIPYEEMVAWFSKADVCWITPLRDGLNLVAKEYAAARRDHGGVLVLSEFTGASVVLDGAVLTNPYSHRRMDEAIDQALAMPPEEQQQRMRKMSAAVEAFTVSDWAEEQMGALREESAAA

SEQ ID NO: 805 - protein, 124 aa, Triticum aestivum
  misc_feature (8)..(8): Xaa can be any naturally occurring amino acid
  misc_feature (11)..(11): Xaa can be any naturally occurring amino acid
  misc_feature (18)..(18): Xaa can be any naturally occurring amino acid
  misc_feature (20)..(20): Xaa can be any naturally occurring amino acid
  misc_feature (22)..(22): Xaa can be any naturally occurring amino acid
  misc_feature (31)..(31): Xaa can be any naturally occurring amino acid
  misc_feature (37)..(39): Xaa can be any naturally occurring amino acid
  misc_feature (44)..(44): Xaa can be any naturally occurring amino acid
  misc_feature (49)..(49): Xaa can be any naturally occurring amino acid
  misc_feature (53)..(54): Xaa can be any naturally occurring amino acid
  misc_feature (60)..(60): Xaa can be any naturally occurring amino acid
  misc_feature (64)..(64): Xaa can be any naturally occurring amino acid
  misc_feature (66)..(66): Xaa can be any naturally occurring amino acid
  misc_feature (69)..(69): Xaa can be any naturally occurring amino acid
  misc_feature (75)..(75): Xaa can be any naturally occurring amino acid
  misc_feature (78)..(78): Xaa can be any naturally occurring amino acid
  misc_feature (80)..(80): Xaa can be any naturally occurring amino acid
  misc_feature (85)..(85): Xaa can be any naturally occurring amino acid
  misc_feature (88)..(90): Xaa can be any naturally occurring amino acid
  misc_feature (92)..(92): Xaa can be any naturally occurring amino acid
  misc_feature (98)..(98): Xaa can be any naturally occurring amino acid
  misc_feature (102)..(102): Xaa can be any naturally occurring amino acid
  misc_feature (104)..(105): Xaa can be any naturally occurring amino acid
  misc_feature (108)..(108): Xaa can be any naturally occurring amino acid
  misc_feature (110)..(110): Xaa can be any naturally occurring amino acid
  misc_feature (112)..(112): Xaa can be any naturally occurring amino acid
  misc_feature (117)..(117): Xaa can be any naturally occurring amino acid
  misc_feature (119)..(121): Xaa can be any naturally occurring amino acid
  misc_feature (123)..(123): Xaa can be any naturally occurring amino acid
MMGRKALXYNXLNENVNXVXYXVRGELYLRXSELQKXXXRIIFXNVGNXHALXXKPLTFXRQVXVXLCXAPFLLXDPXVXLIFPXDCXXXGXHYLSLXRPEXLXXYSXFXMXPGVRXEXXXFXQ

SEQ ID NO: 806 - protein, 179 aa, Glomus intraradices
SLEYIMCQQENHGPLILSEFTGMAGSLGAAIMVNPWDYSGVAKAINDALNLPAEEKKFKHMQLYKQVTNHTAQSWADSFVKELIVSLNNKDQSNVTPYLDFKYLQRKYKAAKKRLLLFDYDGTLTPIVKIPSAAVPPSNLLEALGALTSDPNNSVWIVSGRDLTALETWLGSVKGLGFS

SEQ ID NO: 807 - protein, 486 aa, Oryza sativa
MSYNHSPSITAETINQKVRIFTYEPCGEIVRHARRLEKEIYENPGSLPFQEIIYCNLGNPQALGQRPINFFREVLSLCDNPSLIDRDEARALFSPCALKRARKIIESLPGRDSGSYTSSQGVRGLREAVADGIAARDGFPSKPDNIFLTDGASSAINMMMQILIRSHEDGILCPLPEYPLYSASIILHGGTMVPYNLTEDSIWGLEIFEVKRCLEDARASGLTIRAMVVINPGNPTGQVLSITNQEEIVEFCRKEGLVILADEVYQENVYTENKRFNSFKKVARSLGYDHHDLSIVSFHSVSMGYYGECGRRGGYMEICGFGDDVIDEMYKLASLTICPNIAGQILISLVMDPPKLGDEAFEIFMVEKEETYSSLLKRAKALQKAFNGLEGVSCNKFEGAMYLFPRLRLPQAAIKAAQLEGVSPDVFYAHRLLDATGIAVVPGSGFHPVSGTSHIRCTILPGEETITAMVPSLQAFHEAFMDEFRG

SEQ ID NO: 808 - protein, 388 aa, Thermoanaerobacter tengcongensis MB4
MNPNKYISDVVKKIPPSGIRKFFDLVTNSKDIISLGVGEPDFVTPWEIRKEGIETLCRGNTTYTSNLGLLELRIAISYFLKTHYDLNYDPEKEIMVTIGASEAIDLALRALLNDGDEVLIPEPSYVSYAPCVILTRGVPVFIPTDEKNNFILTPDDLRSKITSKTKALILLYPNNPTGAIMKKEDLEEIVDVIIEKDLIVISDEIYSELTYEGKHVSIASLPGMKERTILINGFSKAFAMTGWRLGYIAAEHEFIEAMNKIHQYTTICAPITAQYAAIKGIYECEEDIIKMRETYDQRRRFIVNGFREIGLDCFEPKGAFYIFPSIKKTGMTSEEFCEKLLKEEKVAVVPGNAFGPSGEGYVRVSYAYSIDKIAKALERIKRFAEKIL

SEQ ID NO: 809 - protein, 95 aa, Glycine max
MPPKPLDYGSINENVKKSQYAVRGELYLRASELQKEGKKIIFTNVGNPHALGQKPLSFPRQVVALCQAPFLLDDPNVGLLFPADAIARAKHYLSL

SEQ ID NO: 810 - protein, 526 aa, Coprinellus congregatus
MFKFAVLSQFVALALAAIGPQADLFIGNANVAPDGFQRSAALAGTDANSMVFPGPVIQAFKGETFNINVRNRLADPSMLRTTSIHWHGFLQAGSAWADGPVGVTQCPIAPNRDFLYTFATARQAGTFWYHSHHRSQYCDGLRGAMVVYDPEDPHRSLYDVDNEDTIITLADWYHPPGPVLETLNVATANSTLINGKGRYPTGPTTPLAVVGVTAGKRYRFRLVSISCSPFFTFSIDGHRMTIIEADGESTQPLVVDSIDIHAGQRYSFVLEANQPVANYWIRSNPNRGNRGFAGGLNTAILRYVGAPDADPVKPSDVDVPVPALPLVETNLHPLENPAAPGPPALGGEGVTAIELQIGLQGREWTVNGATFHEPNEPILLQTLNGKQMNELLPNQGSLFPIPRNSVIELTMPGGGAGSPHPMHLHGHMFSVIRSASNSTPNFVNPVRRDVVSLGSNTADRVTVRFVTDNAGPWIMHCHIDWHLVHGLSVVFVEDIEGISDSQRVAEDHPWRQLCPIYEQEKPDNEP

SEQ ID NO: 811 - protein, 474 aa, Aspergillus nidulans FGSC A4
MADKKRQLLIISNRLPLSLQKVDGKYESTLSSGGLVTALSGVSKSTNVRWFGWPGSNIEDPEERKTANEALAENNAVGIFLDEALAHSHYNVFSNGIAWPILHYQSGVDFNEDAWKSYKKVNEIFADSVAESASDGDLIWIHDYHLLLLPAYLRDRLEKQGKKCPIGFTLHTPFPAEDFWRALPVQKELLAGVLACDLIGFHTDEYKRNFIECCSRGLDVSVKDDSIVYQGHTARTGTFVVGVDPAKFTDGLQTTEVKNRIKELEDEYKHKTVILGVDRLDYTKGLVQKLQGYDYFLRQHPELKNKVRLIQVAIPSREDVKEYQELERELSMLVGKINGEHSTPDGTPIIYLHHSVPFTDLTALYRIADICLITSRRDGMNLVAAEYVACQKDRFGVLVLSELAGAASFMSKGSITFNPSSAQQLADAVYKAATMSPEEKKQGYLQLEEFITNNTRYAPHLPTSSAQQLWYTDQ

SEQ ID NO: 812 - protein, 144 aa, Trichodesmium erythraeum
KMGLFFGTTTGKTEEAAEKIKEEFGGDDVVTIHDISEASPEDFDGYQNVIIGCPTWDVGELQSDWSGFYSEELDNVKFTGKKVAYFGTGDQIGYADNFQDAMGILEEKITGLGGTTIGSWSTEGYDHVDSKAVKNGKFVGLALD

SEQ ID NO: 813 - protein, 395 aa, Clostridium acetobutylicum ATCC 824
MNFSNRVHNMDFSPIRKLVPLSKAAEDRGIKVYHLNIGQPDVKTPDTFFQGITNYNEKIVKYSDSQGIDTLIDSFIRSLSDSNIYFEKDEIMITHGGSEAIQFAIMATCDPGDEILSPEPFYSNYNSFAKVSGAKIVPFETKIEDNFHLPKKEEIIAKITDKTKCIMLSNPCNPTGTVYSYEEMRMLGEIAKEYNLFIISDEVYRQFIFDNVPYTSSIHLTDILDRVILVDSISKHYSACGARIGLVASKNKDLMHQILKLCQARLCVSTIEQYAAANLINTMGSYITDVKMAYKKRRDIMYSGLSSIPGVICSKPEGAFYILAKLPVDDSDAFAKWLLTDFSYNNETVMFAPASGFYATLGLGKSEARFSYCTSIEDIENSIVILKKALEEYNK

SEQ ID NO: 814 - protein, 404 aa, Vibrio sp. Ex25
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGKPVHYLCDEGADWYPDLEDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAYELINQIPGVSCVKPKGAMYLFPKIDTKMYNIKNDQQMVLDFLKQEKVLLVQGSGFNWPKPDHFRIVTLPHVEDLEIAIGRFERFLSTYSQ

SEQ ID NO: 815 - protein, 576 aa, Zea mays
KWHSQLKGQRFMSSIEKSSKLDNVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQSMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAAMAPDVFTITFNGLSKTYRVAGFRQGWMVLSGPQKHAKGYIEGLEMLASMRLCANVPAQHAIQTALGGYQSISEFIVPGGRLYEQRNRAWELINEIPGVSCVKPKGALYMFPKIDAKRFNIHDDQKMVLDFLLQEKVLLVQGTAFNWPWPDHVRIVTLPRMDDLEMSITRFGRFLSDKVAMVAHALAAIKNRKFGGQVNAERIALLAMYHDASEVLTGDLPTPVKYFNSQIAQEYKAIEKIAQQKLVEMVPEELRDIFSELIDEHYYSADEKLIVKQADALCAYLKCLEELSAGNNEFMLAKSRLEKTLDARRSPEMDYFMQVFVPSFHLSLDEISQDSPL

SEQ ID NO: 816 - protein, 225 aa, Brassica napus
MALEYESLNENVKKCQYAVRGELYLRASELQKEGKKIIFTNVGNPHALGQKPLTFPRQVVALCQAPFLLDDPNVGMIFPADAIARAKHYLSLTSGGLGAYSDSRGLPGVRKEVAEFIQRRDGYPSDPELIFLTDGASKGVMQILNCVIRGERDGILVPVPQYPLYSATILLLGGSLVPYYLDESENWGLDVNNLRQSVAQARSQGISVRAMVIINPGNPTGQCLS

SEQ ID NO: 817 - protein, 455 aa, Xanthomonas oryzae pv. oryzae KACC10331
MSRLVVVSNRVAVPGENRAGGLAVGLLAALKERGGMWFGWSGKTVRGDSGGMHEQTEGDITFVTMDLNKRDIDSYYNGFANRTLWPLLHFRLDLVDYDRATREGYMRVNRLFAEKLAPLLKDSDTLWIHDYHMIPLCAMLRELGVGCKMGFFLHVPMPSADLVQAMPDHARLFNTFYAYDLVGFQTQRDAERFKAYVRLFGGGRILQGDLVEGPGGRRFTASSFPIGINTDLIANQAKASVGKQAVRDLRESLRGRQLAIGVDRLDYSKGLPERFQGFERYLERYPDQSGSLTYLQIAPVSRGDVTEYRQLRSQLEQIAGHINGGHAEPDWTPLRYVNQNFSHATLTGFYRAASVCLVTPLRDGMNLVAKEFVAAQDPENPGVLVLSLFAGAADEMKEALLVNPHDLDGVADAIATAASMPLVSRIERWHAMMDHLRKNNINHWRQRYLEALSEV

SEQ ID NO: 818 - protein, 399 aa, Robiginitalea biformata HTCC2501
MPTLSKKGQAMPASPIRKLVPYAEAAKKSGVEVIHLNIGQPDIKTPSQALEAVRNFRTEVLEYSRSEGSESYRAKLADYYGKQGIAVTREQILVTTGGSEALSFVMSCVADLGDEIIIPEPFYANYNGFATATGVTVVPVASGISDNFALPPISDFESYIGPRTRAILLCNPGNPTGYLYSPEEIRSLAELVRRHDLFLIADEVYREFAYDGKKHYSILQEPGLEDNAVVVDSVSKRYSMCGARIGCIITRNEQLMQAALKFAQARLSPPTFAQVASEAALDTPPSYFEAVNAEYTRRRDVLLEELGKIPGILVARPQGAFYCMVELPIRDADHFAQWLLEEFRLEGATVMLAPAAGFYATPGLGENQVRIAYVLEENQLRKAVRILAAALEKYQADGH

SEQ ID NO: 819 - protein, 673 aa, Gossypium barbadense
MAFPASDIPSAEQQADDPLYRELWHACAGPLVTLPRVGERVYYFPQGHMEQLEASMHQGLEHQMPSFDLPSKILCKVASVQRKAEPDTDEVYAQITLVPEVDQSEVMSPDDPLQEPERCIVHSFCKTLTASDTSTHGGFSVLRRHADDCLPPLDMTQQPPWQELIATDLHGNEWHFRHIFRGQPRRHLLTTGWSVFVSSKKLVAGDAFIFLRGANGDLRVGVRRLMRQQANMPSSVISSHSMHLGVLATASYALSTRSMFSIFYKPRTSLSEFIVSVNKYLEARSHKLSVGMRFKMRFEGEEVPERRFSGTIVGVEADKSSGWADSEWRSLKVQWDEPSSIIRPDRVSPWELEPLVATSNSSISQPAQRNKRARPPVLPSPSSDLSSLGIWKSPVESPFSYCDAQRGQPSPKLSSTAKPNSVGFSGNSSLAAVSSSSKYWPNRVENVTESVAPVVNKESSERKQGTGNGCRLFGIQLIDNINMEENSPLATISGTGVNDQPLHSLDANSDQQSDPSNLNQSDLPSISCEPEKCLRSPQESQSKQIRSCTKVHMQGMAVGRAVDLTRFDCYEDLLKKLEYMFDIKGQLCGSTKNWQVVYTDDEDDMMMVGDDPWNEFCSMVRKIFIYTSEEVRKLSPKIKLPVNDDDDDSKATKAGVDTVINPEDRSSIVGQGC

SEQ ID NO: 820 - protein, 913 aa, Oryza sativa Indica Group
MSRSYTNLLDLAEGNFAALGPGGGGGGRRRSGSFGLKRMSRVMTVPGTLSELDGEDDSEHAATNSVASDVPSSVAGDRVIVVSNQLPVVARRRPDGRGWSFSWDDDSLLLQLRDGIPDEMEVFFVGSLRAEIPVADQEEVSQALLDRFRCAPVFLPDPLNERFYHRFCKRHLWPLFHYMLPFSSSASPSPSSSSSSSSSSPSSSSGSGRFDRGAWEAYVLANKFFFEKVVEVINPEDDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGVHMGQLKTVLSLPDREWRVSELQQQFEGKTVLLGVDDMDIFKGINLKLLAFENMLRTHPKWQGRAVLVQIANPARGKGKDLEAIQAEIHESCKRINGEFGQSGYSPVVFIDRDVSSVEKIAYYTIAECVVVTAVRDGMNLTPYEYIVCRQGSDSTSEVNGPKKSMLVVSEFIGCSPSLSGAIRVNPWNIEATAEALNEAISMSEQEKHLRHEKHYRYVSTHDVAYWSKSFIQDLERACKDHFRRTCWGIGLGFGFRVVALDPHFTKLNMDSIVMAYERSESRAIFLDYDGTLVPQTSISRTPSAEVLRIINTLCSDRRNKVFLVSGRRRDKLGEWFSSCPDLGIAAEHGYFLRWTRDEEWQTCTQTSDFGWMEMAKPVMNLYTEATDGSYIDPKESALVWHHQDADPGFGSSQAKELLDHLESVLANEPVSVKSGQFIVEVKPQGVSKGVVAEKILVSMKERGKQADFVLCIGDDRSDEDMFENIADTIKKGMVATNTSLFACTVGQKPSKAKFYLDDTFEVVTMLSALADATEPEPETDLTDEFDELAVSVSSVDIDDEQTPSDKLIGG

SEQ ID NO: 821 - protein, 727 aa, uncultured archaeon GZfos37D1
MRRLLIISNRLPVSVERRKNEFRFSSSVGGLATGLNALHQRYESVWVGWPGIAINREETDYVESKLSEFNCYPVFLSQGEVEKYYYGFSNKTLWPLFHYFPQYAKYEHSEWSTYEHVNRKFCERVAEIAKPEDVIWIHDYHLMLLPGLIRERFPDATIGFFLHIPFPSADLFRLIPWRRRILEGVLGADLIGFHTYDYAHNFLSSVLRLLGYEHELGKFAIGDRIVQVDVHPMGIEVQKFVRATSRRGIKREVARLRSRFKNCKIIFSMDRLDYTKGIPERLYAFEHFLETHPEWHEKVVFILKIAPSRTKVGQYRVLKQEIDELVGRINGKYGTPEWVPISYFYRSLPFQTIVAFYLAADVALLTSMRDGMNLIAKEFVASRVDGKGVLILSEMAGAARELGEALVVNPNNKEEVAEALNEALRMPEEEQKSRNEEMQKRLRHYDVFHWGSGFIRRVLETKRLQEELNMKKLSEKIREELKNAYKAADKCLLLLDYDGTLVPFADKPERAKPDKELLDIFRALSKSPENTVVIISGRDKETLERWFGDTGVCLVAEHGVRLKEEEGEWKEIELLKEDWKEKIIHILDLFVDRAPGSFIEEKSFSLVWHYRKVDPELGELRAKELTDQLIDLTACTELQVMKGNKVVEVKDGRLNKGIAASHWLTKGFGFILAVGDDLTDEDMFKVLPEGAYSVKIGFTPSKARFYLGSPKEVRALLDEMELVEVYK

SEQ ID NO: 822 - protein, 173 aa, Photorhabdus luminescens subsp. laumondii TTO1
MMKIGLFYGSSTCYTEMVAEKIRDILGEDLIDLHNIKETAPKLMETYSVLILGIPTWDFGELQEDWLVIWDQIPSLNLQGKIVAMYGMGDQIDYSDWFLDALGMLYHHLRPSGVHFIGFWPTESYEFTSPKPLTDNGSQFVGLALDDVNQYEQTDDRLSQWCMQILQEMEPLL

SEQ ID NO: 823 - protein, 417 aa, Zea mays
VVALCQAPFLLDDPHVGLMFPADAIARAKHYLAMAPGGLRPYSDSRGIPGIRKEVADFIHKRDGYPSDPELIYLTDGASKGVMQILNTIIRNEMDGILVPVPQYPLYSATISLYGGSLVPYYLEEEANWSLDFVNIRQTVAEARSKGISVRAMVMINPGNPTGQCLSEANIKELLQFCYHENLVLLADEVYQQNIYQDERPFISARKVMFDMGPPISSELQVVSFHTVSKGYWGECGQRGGYFEMTNLPPKTVDEIYKVASIALSPNVPGQIFMGVMVNPPKPGDISYLKFAAESKSIHESLRRRARMMTDGFNSCRNVVCNFTEGAMYSFPQIRLPPRAIEAARRAGKSADVFYCLKLLEATGISTVPGSGFGQKEGVFHLRTTILPAEEDFPAIMSSFKKFNDSFMEQYEGYSRL

SEQ ID NO: 824 - protein, 473 aa, Salmonella enterica subsp. enterica serovar Typhi str. CT18
MSRLVVVSNRIAPPDNKGGAGGLAVGVLGALKAAGGLWFGWSGETGNEDEPLKKVTKGNITWASFNLSEQDYEDYYCQFSNAVLWPAFHYRLDLVQFQRPAWEGYMRVNALLADKLLPLIKENDIIWVHDYHLLPFASELRKRGVNNRIGFFLHIPFPTPEIFNALPPHDELLEQLCDFDLLGFQTENDRLAFLDSLSSQTRVTTRSGKQHIAWGKDFQTEVYPIGIEPDEIALQAAGPLPPKLAQLKAELKNVKNIFSVERLDYSKGLPERFLAYEALLENYPQHRGKIRYTQIAPTSRGEVQAYQDIRHQLETEAGRINGKYGQLGWTPLYYLNQHFDRKLLMKIFRYSDVGLVTPLRDGMNLVAKEFVAAQDPANPGVLVLSQFAGAANELTSALIVNPYDRDDVAAALNRALTMPLAERISRHAEMLDVIVKNDINRWQERFIHDLKEVTPRSPERQQQNNVATFPKLA

SEQ ID NO: 825 - protein, 571 aa, Physcomitrella patens subsp. patens
MEFLTEPKQALVTITVLLLTLLAQAKYSIAETHFLYWEVVTKEFTRNCGSVNITTVNGMYPGPVVNITEGDTVVVNVTNMQEYPVTIHWHGIFQFMTNWADGPAHFTQCSLKTGNSQIYEFIVSGQSGTFFWHAHNNWLRATMFGAFIVHPRDPPPNYGVEVAGEFSMISGEWFDTQPNDVEMGYLYRPIPVDTSKTANTLNGLTGPLYNCTPDDVPETQVFRVQNGSTYLLRLTNAGLNNNHWFTVANHTLTVVSVDGNYVKPFATDAVLIAPGQTTDVLLTANQTIGSYYGGVGLAQIPQVGPPLEAREALAIIEYEGAPADFPLSTPPFPAPSDPMVVDDYTAKVLGYTDMDLPETMDHNLVYVVGIALVDCIPSEPCTSTQKLAGTVQNFTFDEPQNSSVLEAYFYNISGVYETGFPELPPEFIDFTGRPSPEYGIGSRATLVKELEFNQTVELVLQNVNAAVMLDHPFHLHGHDFYVVGRNYGNFNQTTDPATFNLRDPPRFNTISVHSGGWVALRFRANNPGVWLLHCHFERHKTWGMEAAFITKNGTQLNETLPGPKHPLPPCI

SEQ ID NO: 826 - protein, 495 aa, Synechococcus sp. WH 8102
MGQSSFVILYHRTPFDEAKDAQGNQVWVDQKSPNGIIPTLRNLFRSRNDGTWIAWRHVDHPEEMDVERLEMTNPSPFALCRIPLADEQISSFYHITSKECFWPILHTFPTHFNVNNANWGIFEEVNKRFADAACNEAAEGATVWVHDYNLWLAPGYIRQQRPDLKIAFFHHTPFPGNDVFAILPWREQILESLLCCDVVGFHIPRYTENFARAASTLVGAKRGPKISVDQKFISVGTALSEGTVTSHLDHNGRRIQLLSSPVGTSPDVIQELSWSASVESYGEMIVQDTKKGRKLILSASRVDYTKGNEELLLAFERLLERREDLHGEVVLMLACVAAASGMKIYEETQRSIEEMAGRINGRFSQVDWIPVRFSTRRIPYEEMVAWFCHADVCWITPLRDGLNLVAKEYAAARRHRGGVLVLSEFTGASVVLEGAVLTNPYSNRRMDEAIEAALAMPEHEQRQRMETMSAAVEAYTVQDWAEEQLAGFPEVATIG

SEQ ID NO: 827 - protein, 446 aa, Vitis vinifera
MPGNRYSFNSSTPRTRLERLLRERELRKFNQSFNLTNEVKDGNREGDPFGNDSANEGDNGGVPNEEEFLEGFTAGRTVGDAFERQDARPSKQRLLVVANRLPVSAVRKGEDSWQLEISVGGLVSALLGVKEFEARWIGWAGVNVPDEIGQKSLAKALAEKRCIPVFLDEEIVHQYYNGYCNNMLWPLFHYLGLPQEDRLATTRSFQSQFDAYKKANQMFADVVNEHYQNGDVVWCHDYHLMFLPKCLKEYNIEMKVGWFLHTPFPSSEIHRTLPSRSELLRSVLAADLVGFHTYDYARHFVSACTRILGLEGTPEGVEDQGKLTRVAAFPIGIDSDRFIRALELPQVQNHIKELKERFAGRKVMLGVDRLDMIKGIPQKILAFEKFLEENPNWRDKVVLLQIAVPTRTDVPEYQKLTSQVHEIVGRINGRFGTLTTVPIHHLDRSS

SEQ ID NO: 828 - protein, 496 aa, Synechococcus sp. CC9605
MGAGQSSFVILYHRTPFDESKDKNGKRIWVDQKSPNGIIPTLRNLFRSCEKGTWIAWRRVNDQSNEGTERFEMDNPSPFTLCRIPLEDEQISSFYHITSKECFWPILHTFPTYFNVNNANWKIFEEVNKRFAMAACAEAAEGATVWVHDYNLWLAPGYIRAERPDLKIAFFHHTPFPGNDVFAILPWREQILESLLCCDVVGFHIPRYTENFARAATTLVGAKRGPKVPVDEKFIEVGTALSEGTVTSHLEHNGRTIQLLSSPVGTSPDLIQELCWSPSVESHGELIVQDTKKGRKLILSASRVDYTKGNEELLLAFERLLERRKDLHGQVVLMLACVAAASGMKIYEDTQRSIEEMAGRINGRFSQIDWVPIRFSTRRIPYDEMIAWFCHADVCWITPLRDGLNLVAKEYAAARRNRGGVLVLSEFTGASVVLDGAVLTNPYSNRRMDEAIESALEMDEDEQRDRMSRMTDAVESYTVSDWADEQMSGLSPSTPQ

SEQ ID NO: 829 - protein, 461 aa, Vitis vinifera
MNLVSYEFVACQASKKGVLILSEFAGAAQSLGAGAILVNPWNITEVAASIGYALNMPADEREKRHWHNFMHVTTHTSQEWALTFVSELNDTIFEAQLRTRQVPPLLPTKDAIERYLQSNNRLLILGFNSTLTEPVDIPGRRGGQIKEMELKLHPDLKEPLKKLCDDPKTTVIILSGSDRGVLDDNFSEYNMWLAAENGMFLRLTTGEWMTTMPDNLNMDWVDSVKHVFEYFTERTPRSHFELRETSLVWNYKYADIEFGRLQARDMLQHLWTGPISNASVDVVQGGRSVEVRAVGVTKGAAIDRILGEIVHNRGMKAPIDYVLCIGHFLGKDEDIYTFFEPELPSEPAAAARTKVVEPVKTSATKVSTSKSGSKPSRCKKQQASSTLEKTCNYGSGSGSGWRPTMHQKPSLHEGSSVLDLKGDNYFSCAVGRKRSKARYLLGSLDDVVTLIKDLAEFSRPC

SEQ ID NO: 830 - protein, 513 aa, Zea mays
  misc_feature (256)..(256): Xaa can be any naturally occurring amino acid
MSYNKAPSITAETINPRVKIIRYAPCGEIVKHAARLEQEIEENPASIPFQEIIYCNLGNPQVLGQPPLTFFREVLSLCDNPALMDRDEARALFSPCSIRRARRILNSIPSKDTGGYTDCRGIKCLRQVVADGITARDGFPSTADDIFLTDGATSAINLMMQILIRSHEDGILSPLPEYPLYSASIILHGGTMVPYNLTEDNGWGLEIFEVKRCLEEARSAGLTVRAMVVINPGNPTGQLRLYQSFSSSTHLIPLVXVLSVTNQEEIVEFCRKEGLVILADEVYQENIYAENKKFHSFKKVARSLAYDENDLTLVSLHSVSMSYGESGRRGGYMEVSGVAANVKDQIYKVASLTLCPNIAGQILVSLAMDPPKLGDESFESFDKEKEQIRSSFCKRAKTLEKAFSGLEGVTCNKLEGALYLFPRLHLPSAAIRAADFEGVSPDIFYAHRLLDATGIAVVPGSGFHQASGTIHIRCTILPDERKIEAMVARLRAFHKAFMNEFRGSQQVMNDLRR

SEQ ID NO: 831 - protein, 411 aa, Aster tripolium
TILLGEWWNANPIDVENAAASCGSAPAESDAYTINGWPGVLFNTAFQFKYYIQARCWPGNTYLLRIINAALNEQFFFKIANHSLTVVGVDAAYTNPYVTDVILLGPGQTTDVLLTADQAPGLYYMAARPYVSAIGVTPNTNTTTAILAYQNATQSTTPPILPVLPALNDTPTAFTFSSNLTGLVTSPFWSPVPQSVDENMFVTMGLGLSACGANQTCGGIFAQRMSSSMNNLSFVLPTTMSLLEAHFRNISGVYTTDFPDQPPVVFDYTNVNNSFDLNLIMTPKSTSVKSVMFNATVQMVLQNTALIGVENHPMHLHGFNFYVLAQGFGNYNATLDSANFNLVNPQERNTLGVPAGGWAVIRFRANNFCVWYFHCHLDVHLTWGFATAILVENGGTPESTLPPPPADFPQC

SEQ ID NO: 832 - protein, 190 aa, Oryza sativa
  misc_feature (37)..(37): Xaa can be any naturally occurring amino acid
KNEGLVLLADEVYQENIYVDNKKFNSFKKIARSMGYXSVNLCSNITGQILASLVMNPPKAGDASYASYKAEKDGIPQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 833 - protein, 389 aa, Fulvimarina pelagi HTCC2506
MLHLSRLRAEARNAPPSGIVAVMQHAFGREGVLPMWAGEGDLSTPDFIARAASESLAKGETFYTHQRGLPELRQALAGYVERLYGRPQSADRFFVTGSGMQAIQISIAALAGAGDEVVYFGPAWPNFAAAAGLIGAKPVEVALRPEDGAWHLDLDKVRDAVSAMTRAIFVNTPANPTGWTASEDELRAILHIARETNTAIIADEIYSRFFYAGTRAPSFHDVMAEDDTILFVNSFSKNWAMTGWRVGWIEAPAELDEVLANLIQYSTSGVAVFMQRAALAALQEGESFVEEQIARAHRARNIFADRLLATNRVALTPPAGAFYAFFSIDGVEDTRAAAFRIVDEAGVGLAPGTAFGPVGTQFLRACFHRRLDEVEMAADRIAGWIGRTL

SEQ ID NO: 834 - protein, 404 aa, Streptococcus suis 89/1591
MKQFNKSTKLDDVAYDIRGPVLEEAMRMRANGEQILRLNTGNPAEFGFTAPDEVIRDLIHNARKSEGYSNSKGIFSARKAIMQYCQLKKFPNVDIEDIYLGNGVSELIVMSMQGLLDNGDEVLVPMPDYPLWTAAVSLAGGKAVHYVCDEAAEWYPDLADMESKVTSRTKAIVLINPNNPTGALYPKEILKGIIDIARRHELIIFSDEIYDRMVFDGAVHIPIATLAPDLFVVTMNGLSKSHRICGFRVGWMVLSGPKKHVKGYIEGLNMLSNMRLCSNVLAQQVVQTSLGGYQSVDELLMPGGRLYEQREFITKAINDIPGLSAVKPKAGLYVFPKIDREMYRVEDDEQFVLDFLKQEKVLLVHGRGFNWKDPDHFRIVYLPRVDELAEIQEKMSRFLRQYRR

SEQ ID NO: 835 - protein, 169 aa, Anabaena sp.
SKKIGLFYGTQTGKTESVAEIIRDEFGNDVVTLHDVSQAEVTDLNDYQYLIIGCPTANIGELQSDWEGLYSELDDVDFNGKLVAYFGTGDQIGYADNFQDAIGILEEKISQRGGKTVGYWSTDGYDFNDSKALRNGKFVGLALDEDNQSDLTDDRIKSWVAQLKSEFGL

SEQ ID NO: 836 - protein, 287 aa, Saccharomycopsis fibuligera
GEINFDENAWFAYNEANKLFAEEIAKHTKENDMIWVHDYHLMLLPELLKQRIAEKKIFNVKLGFFLHTPFPSSEIYRILPVRKEIMAGVLSCDLIGFHTYDYARHFLSSVSKVLHLNTLPNGIEYNDRFISVGAFPIGIDVDKFVNGLKTDTVQQRIKQLRAKLGDDIKVIVGVDRLDYIKGVPQKLHAFEVFLNEHPEMVGKVILIQLAIPSRGDVEEYQNLRATVNELVGRINGKFGTIDFVPIHFMHRSVPFNELISLYNISDVCLVSSTRDGMNLVSYEYIAC

SEQ ID NO: 837 - protein, 520 aa, Ganoderma lucidum
MVKFQSLLSCVTLLFAASAHAGIGPKADLTISNANIAPDGYTRAAVVVNGVFPGPLITGNKGDRFQLNVIDQLTNHTMLKTTSIHWHGFFQKGTNWADGPAFINQCPIASGHSFLYDFQVPDQAGTFWYHSHLSTQYCDGLRGPFVVYDPKDPLKGLYDVDNDSTVITLSDWYHVAARLGPSFPLGSDSTLINGLGRSTTNATAGLAVINVTQGKRYRFRLVSLSCDPNYTFSIDGHDMSVIEADGIATQPVTANAIQIFSAQRYSFVLTANQTIGNYWIRANPSFGNIGFTNGINSAILRYSGADPIEPTTAQQTTQNLLNEVDLHPFVAKQTPGRATQGGTDVAINMVFNFNGSNFFINNASFTPPTVPVLLQILSGAQAAQDLLPSGSVYTLPINKSIELTFPATVNAPGAPHPFHLHGHSFAVVRSAGSTEYNYNNPVWRDVVSTGTPAAGDNVTIRFQTDNPGPWFLHCHIDFHLEAGFAVVFAEDTADTSLANHVPQAWSDLCPTYDALSADDH

SEQ ID NO: 838 - protein, 173 aa, Salmonella enterica subsp. enterica serovar Typhi str. CT18
MNMGLFYGSSTCYTEMAAEKIRDILGPELVTLHNLKDDAPALMEQYDVLILGIPTWDFGEIQEDWEAVWEQLDDLNLEGKIVALYGMGDQLGYGEWFLDALGMLHDKLALKGVKFVGYWPTEGYEFTSNKPVIADGQLFVGLALDETNQYDLSDERIQTWCEQILGEMAEHYA

SEQ ID NO: 839 - protein, 148 aa, Listeria monocytogenes str. 4b F2365
MTKVMIVYASMTGNTQEIADILGEELEKYDIEVEIEECISVDPEDLLEYDGALIGGYTYDDGQLPDEFVDFYEDMADVDFSGKVCASFGSGDTFYDEYCLTVDLIETRLKEQGATVPVAGLKVDLDPDEEDVVRAESYAKTFVDVLKG

SEQ ID NO: 840 - protein, 181 aa, Zea mays
  misc_feature (26)..(26): Xaa can be any naturally occurring amino acid
SKVASIVLSPNVPGQIFLGGVVNPPXPGGFFFPKFPAESKSFLDFLGGGGGRMADGFNSCRNVGGNFPEGGLFFFPPIQLPARAIGGAKGAGKAAGVFFCLKFLGATGVSPFPGFGFGQKEGGFPLWATFLPPGGGFPPLLSGFKKFNGSFLGQFGGFSRVGGHPEKKGPRPPFVFFAPFC

SEQ ID NO: 841 - protein, 987 aa, Cryptococcus neoformans var. grubii H99
MDSMHPDPTPEVPPSLPDLKAQVARLEASHKEKGLPLSGRIIHVMHHLPVEIVRIVPADALESAGTGFLSPPMTPEFKPEDAETTVESADAKWRIHARTAHPALVSGIKSLSETHDQLLVAWTGEVLIQPDNTQSPQQPSQATFSSIASNLLAPFSAGDATPQPQPPPQQGSLMVFGGEFNEADQKEIASELDRFAEAEAKFDPTDRLKYIPVFLPPDVSKGHYEGFCKKTLWPLFHYLLWLDSTATVPSPDPSWLAYQKTNQMFAQRVAQIYKPGDLIICHDYHLLLAPKMIRESLGQVFHPNAGWGTAHPSPSLHHAQRKGFDWESNQQTPTPEKAKGEKIGAFMNHVGTALGNHLGTMEHGLQNEIMIGMFMHTPWPSSEIFRCLPKRREILDGMLGANLVSFQTYSYSRHFVSTCIRVCGYESTPGGVDANGQVTAVGYCPIGIDIKRVVHDRDQPGVLPKMQALRDLYKDKKIIVGREKLDVAKGVYNKLQAFEKFLQVYPEWRGKVVLIQVTTPALSESPKLERMTAELVSHINGTYGSLDFTPVHHYHQALEKDEYFGLLSCADLALITSLRDGMNTTSMEFILCQDKTSKSPLVLSEFMGTAPSFASALQINPHDLLGVAQAINKGLTMRKEEKAERHANLLEGVLAHTSHTWAATILKQLLENVGGEHTAHHTPALDTAQFTDAYKKANKRLLLFDYDGTLTPIVKVPSHAVPTERTRNAIAALCKDPKNVVYLISGRDGDFLEEHWGHLDRLGLSAEHGSFVKQPGEEDFINMTEALDMSWMSEVEEIFKYYTERTTGSTIEVKKASITWHYRNSDPDFGEFQCKQALDLLESSLAPRRPIEVLVGKKNLEVRPLAVNKGEIVRRLMYENPDVDLIFCAGDDKTDEDMFRALRTIFPPGGVVDNNPVVMKPPVAVTSALEPEEVAELPDVELTIRSKGVFATTVGPPAKRTLAGWHVTCPEEVVEAFESLLEEIQVV

SEQ ID NO: 842 - protein, 490 aa, Petunia x hybrida
MGFESEKNNSVLSKLATNEEHGENSPYFDGWKAYDNDPFHPLKNPNGVIQMGLAENQLCFDLIEDWIKRNPKASICTTEGIKSFRGIANFQDYHGLPEFRRAIAKFMEKTRGGRVSFDPDRVVMAGGATGANETIIFCLADAGDAFLVPSPYYPAFNRDLRWRTGVQLIPIPCESSNSFKITTKAMKEAYENAIKANIRVKGLILTNPSNPLGTTLDRDTLKSLLNFTNERNIHLVCDEIYAATVFNTPQFVSIAEILNDEKSNFNKDLVHIVYSLSKDMGLPGFRIGIVYSYNDAVVNCARKMSSFGLVSTQTQHLLAKMLSDEEFVANFLCESSMRLGKRHKHFTNGLEQVGIKCLKSNSGLFCWMDLRHLLENSTLDSEMSLWRVIINDVRLNVSPGSSFDCQEPGWFRVCFANMDDETVEVALARIRRFVGVGVKENGEETKPVKNKEQWKKSNLRVSFSKRMYDESVLSPLSSPIPHSPLVRART

SEQ ID NO: 843 - protein, 125 aa, Zea mays
RCSKSIHESLRRRARMMTDGFNSCRNVVCNFTEGAMYSFPQIRLPPRAIEAARRAGKSADVFYCLKLLEATGISTVPGSGFGQKEGVFHLRTTILPAEEDFPAIMSSFKKFNDSFMEQYEGYSRL

SEQ ID NO: 844 - protein, 546 aa, Oryza sativa Japonica Group
MRGDETSSLLFIHPWPPSLEAHHRHTGSLLHSAFLARSPHLTSLTYIAGSIAPSPAANEMLRAAARALTVSSLNPKVLALADHHLGGLVARRAQSMQQELDANPASHPFSEIIYCNHSNPQSQGQQPNKFFREVLALCNHPHLLDRSEASFMFSSDAITRAREIVGFIPGKTTGGYSHCQGIEGLRDAIAAGIASRDGLPSYSEDIFLTDGAAAPVHMMMHLLIRGKKDGILCPIPSHSLYTDSMVLRGATLVPYYLDESRGWSVNISDLKKQLDGARAKGIDVRGLVVVNPGNPTGQVLVEENQCEIVELCKNECLVLLADEVYQENIYTDQKKFNSFKKVARSIGYGEGDISLVSFHSVSNGYYGECGRRGGYMEVTGFSSEVRGEVYKVASLSACSNISGQILMSLVMNPPKVGDESYPSYRAERDSILSSLSCCAEAMVSTFNSMEGMTCNKAEGGISVFPSVRLPPRAIEAAEAMNTEPDVFYALRLLESTGIVVVPGSVFGQVPGTWHFRCTILPQEEKTRQIISRFNVFHEAFMEEFRS

SEQ ID NO: 845 - protein, 163 aa, Campylobacter upsaliensis RM3195
MAVAVIYGSAMGNTESAANIIADKLGISDVLNIADIDADKINSYDKLICGTSTWGSGDLQDDWDGFDFSGLSLSGKVVAVFGMGDSESYSDTYCGGMGKLAQNLKDAGATLVGEVSTDGYNFEASDAVVDGKFVGLALDNDNQEDQTEARIDAWIAQIKPQFS

SEQ ID NO: 846 - protein, 174 aa, Azotobacter vinelandii
MSRIGIFYGSSSGVTGKVAEKLAELLGEERCDLYNMEEDFVDFDDMLKYDHLLFGCSTWGSGEVQNDWRDPLLELDNEKPDFSGKTIALFGAGDYVSHGEQFVSALGVLYDKFKARGAALVGSFPTDGYTYEYSFAVRDGKFVGLPFDKINEVDKTDERLERWIAVLQEEFLPA

SEQ ID NO: 847 - protein, 727 aa, uncultured archaeon GZfos34A6
MRRLLIISNRLPVSVERRKNEFRFSSSVGGLATGLNALHQRYESVWVGWPGIAINREETDYVESKLSEFNCYPVFLSQGEVEKYYYGFSNKTLWPLFHYFPQYAKYEHSEWSAYEHVNRKFCERVAEIAKPEDVIWIHDYHLMLLPGLIRERFPDATIGFFLHIPFPSADLFRLIPWRRRILEGVLGADLIGFHTYDYAHNFLCSVLRLLGYEHELGKFAIGDRIVQVDVHPMGIEVQKFVSATSGRGIKREVARLRSRFKNCKIIFSMDRLDYTKGIPERLFAFELFLETHPEWHEKVVFILKIAPSRTKGGQYRVLKQEIDELVGRINGKYGTPEWAPISYFYRSLPFQTIVAFYLAADVALLTSMRDGMNLIAKEFVASRVDGKGVLILSEMAGAARELGEALVVNPNNKEEVVEALNEALRMPEEEQKSRNEEMQKRLCHYDVFHWGSGFIRSVLETKRLQEELNMKKLSEKIREELKNAYKAADKCLLLLDYDGTLVPFADKPERAKPDKELLYLFRALSEPPENTVVIISGRDKETLERWFGGTEVCLVAEHGVWLREEEGEWEAIELLKEDWKEKIIPILDLFVDRAPGSFIEEKSFSLVWHYRKVDPELGELRAKELTDQLIDLAACTELQVMKGNKVVEVKDGRVNKGIAASHWLTKGFGFILAVGDDLTDEDMFKVLPGDAYSVKIGFTPSKARFYLGSPKEVRALLDEMEMVEVYK

SEQ ID NO: 848 - protein, 492 aa, Leifsonia xyli subsp. xyli str. CTCB07
MIVSNRLPVDRVVDETGESSWRPSPGGLVAALKPVMRAEDGVWIGWAGVAGEEVEPFEVDGIAILPVPLSEQDLQEYYEGFSNDTLWPLYHDVIAPPSYHREWWETYVAVNRRFAAAAAAVAAKGAVVWVHDYQLQLVPEMLRESRPDLVIGFFNHIPFPPYGIYSQLPWRRQIIDGLLGADVVGFQRVADASNFSRAVRRLKGYETRGPIIDVPIESDDPEAGSHRHVTANRHGGLVRTVLARAFPISIDVEQYQELARRPEIRARAAAIREELGNPETIMLGVDRLDYTKGIGHRLKAFGELLRDGRLDVEKATLVQVASPSRERVETYRQLRDEIELTVGRINGDYSTLGHTAVAYLHHGYPREEMVALYLAADVMLVTALRDGMNLVAKEYVATRVDEDGVLILSEFAGASDELRQALLINPHDIEGLKDAIAQAVEMPRRDRTRRMRALRKKVLTNDVARWSASFLDALIRRAHGDHPLQNSPVNRR

SEQ ID NO: 849 - protein, 459 aa, Oryza sativa Japonica Group
MATGVSVENINPKVILGPSSIAECIVTNARREINRYLTFFFQHLQQQLQTQPGSLPFDEIVYCNIGNPQSLGQKPITFFREVLALCNHPNLLEREEIKSLFSTDAIARAKKILSMIPGRATGAYSHSQVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEVYQENIYVTNKKINSFKKIARSMGYNGDDLQLVSLHSVSKGYYGECGKRGGYMEVTGFSTPVREQLYKIASVNLCSNITGQILASLIMDPPKAGDASYDLYEEEKDNILKSLSRRAKAMESAFNSIDGITCNKTEGAMYLFPRIYLPQKAIEAARAVNKAPDVFYALRLLDTTGIVVTPGSGFGQVAGTWHVRCTILPQEEKIPSMISRFREFHEEFMSQYRD

SEQ ID NO: 850 - protein, 624 aa, Cryptococcus neoformans var. neoformans
MRGLAKLFFLSCSFVSLVSSEKTDESPTAVSDNYMPKATATIDPSVFALSNDFEITDVPTTREYTFDIAKAFASPDGYEREVYVVNNMFPGPVIEANTGDTIIVHVNNHLDEGQSLHWHGLRQLGTAFMDGVPGITQCPIPPGGSFTYNFTVSHQSGTYWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISVAPGERYSAIINTNEGKEGDAFWLRTSVALSCMFGAVSQEGLAVVRYTGNGIVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPAKRSSSPSIQSSKTSSFQYLREVKGKVVKRRGAREA

SEQ ID NO: 851 - protein, 573 aa, Capsella rubella
MATWVLHYLSVAFLITISYNIDAASAGITRHYQFDIQLKNITRLCKTKTIVTVNGKFPGPKVTAREGDNLQIKVVNHVSNNISIHWHGIRQLRTGWADGPSYVTQCPIRTGQSYVYNFTVTGQRGTLWWHAHIQWMRATVYGPLIILPKLHQPYPFPKPYKQVPIIFGEWFNADPQAVVQQALQTGGGPNASDAHTFNGLPGPLYNCSTKDTYKLMVKPGKTYLLRLINAALDDELFFTIANHTLTVVEADASYVKPFQTSIVLLGPGQTTNVLLKTKPSYPNATFYMLARPYFTGQGTIDNTTVAGILQYQHHSQSSKNLSIIKPSLPPINSTSYAANFTKMFRSLASSTFPANVPKTVDKKFFFTVGLGTNPCPKNQTCQGPTNTTKFAASINNVSFILPNKTSLLQSYFLGKSKNVFMTDFPTAPIFPFNYTGTPPNNTMVSRGTKVVVLKYNTTVELVLQGTSILGIEAHPIHLHGFNFFVVGQGFGNFNPAIDPKQYNLVDPVERNTINVPSGGWVAIRFLADNPGVWLMHCHIEIHLSWGLTMAWVVLDGDLPNQKILPPPSDFPKC

SEQ ID NO: 852 - protein, 177 aa, Azoarcus sp. BH72
MSRIGIFYGSSSGVTKAAAEKLAGFLGEDRCDLYSMEEDFVDFDEMLDYDFLLFGCSTWGSGEVQNDWRDPLLDLDNDKPDFSGKTIAVFGAGDYVSHGEQFVSALGILYDKFKARGATLVGSFPTEGYTYKYSFAERDGQFVGLPFDDINEADKTEARLQAWVEVLQAYLPEAEEA

SEQ ID NO: 853 - protein, 507 aa, Saccharomyces cerevisiae
MTMTHQQDLKGVFTAKDLDFKPAGKITKKDLNTGVTKAEYAVRGAIPTRADELKEELKKNPEVLPFDDIINANIGNPQQLDQKPLTFTRQVLAILEYPEILRVGHNELASLNLFSRDALERAERLLNDIGGSIGAYSHSQGVPGIRQTVADFITRRDGGEPATPEDIYLTTGASSAATSLLSLLCKDSQTGLLIPIPQYPLYTASASLFNAQVLPYYLDEESNWSTNSDEIEKVVQDALKKQIRPSVLIVINPGNPTGAVLSEETIARICLIAAKYGITIISDEVYQENIFNDVKFHSMKKVLRKLQHLYPGKFDNVQLASLHSISKGFMDECGQRGGYMEIIGFSQEIRDALFKLMSISICSVVTGQAVVDLMVKPPQPGDESYEQDHDERLKIFHEMRTRANLLYETFKELEGIECQEPQGAMYLFPRLVLPKKALCESERLGIEPDEFYCTSLLESTGICTVPGSGFGQRPGTYHVRTTFLAPGTKWIQDWKEFHQDFFSKYRN

SEQ ID NO: 854 - protein, 496 aa, Synechococcus sp. WH 7803
MLINEGKSDFIILYHRTPFDESTDELGNRIWRDQKSPNGIIPTLRNLFRSRENGTWIAWRRVDDVKNERDERIVMNNPATFSLRRIPLEQEQISSFYHVTSKESFWPILHTFPTYFDVNNANWQIFEEVNQRFANAACAEAAEGATVWIHDYNLWLVSGFIREKRPDLKIAFFHHTPFPGNDVFAILPWRKQIIESLLACDVVGFHIPRYTENFARAASCLLGVEKGPKESVATKFLKFGSALTEPTETPWLKYKNRKVKLVSSPVGTSPDVIQTLAVRNDVAELSKKIDEDTKKGRKLILSASRVDYTKGNEELLLAFERLLERRPDLHGKVVLMLACVAAASGMKIYEETQRLIEETAGRINGRFSLIDWVPIRFSTNRIPYEEMIAWFSKSDICWITPLRDGLNLVAKEYVAARKGRDGVLVLSEFTGASVVLDGALLTNPYSHKQMDDAIETALALPQEEQVSRMKKMVDAVDEFTVTDWANEQMQSLETVD

SEQ ID NO: 855 - protein, 404 aa, Photobacterium sp. SKA34
MQKFGMSSKLNNVCYDIRGPVLKHAKRMEEEGQKILKLNIGNPAPFGFDAPDEILVDVIRNLPTSQGYCDSKGIYSARKAVVQHYQKRGLLDLDVEDVYIGNGVSELIVMAMQALLNHKDEILVPSPDYPLWTAAVSLSGGTPVHYTCDEQSDWYPDLDDIKKKITPNTRGIVLINPNNPTGAVYSRDFLIEVVEVARQHDLIIFADEIYDKILYDGAQHTSIAPLAEDVVCVTFNGLSKSYRVCGFRAGWMIISGPRHRAKGYIEGLEMLSSMRLCANVPMQHAIQTALGGYQSINELILPGGRLLEQRNKAYDLLTQIPGVSCVKPKGALYLFPKLDQKKFNIQDDQKMAMDFLLQEKVLVVHGTGFNWKQPDHFRIVTLPHVDDLELAMGRLERFLHSYRQ

SEQ ID NO: 856 - protein, 673 aa, Aspergillus nidulans FGSC A4
MHRMLFVCGLFLLSVQGLLIRHDGSFQPDHILRVNSKNYMQACSPRYSVLVNGSFPGPEIRVQEGQTSWIRVYNDMENLNVTMHWHGLTAITAPFSDGTPMASQWPIPPGHFFDYEVKVEPGYAGTYFYHSHVGFQAVTAAGPLIVESTKPPPYFYDEERIIALSDFFSKTDKEIEHGLMSSQFQWSGETEAVLVNGHSLSPSPMNGTGSCRREVLQVEPGKTYRLRIIGATALSFISFVIESHDVEIIEADGHYTQKLKTHNLQIAGGQRYSVLLKAKDNAALEQLSQRHFIIQITTLARPTTLTTYAILQYPSNAPASLTNVSATPLMPVPSIAYGWLDYQLQPLERDPDFLTSDSVTRRIVIDVHQNFSDHVLWLQSGYDWVETFPETPYLVQIQRGELNVTESLQKAISAGNNFDKDYRIFPAQLGEVLEIVWQNRGAVGNSTVRNRGVETHPFHGHGRHFYDIGGGDGEYNAAENEKRLQETQPVLRDTTVLYGYSREVAPGAPSGWRAWRIRVTNPGVWMMHCHTLQHMIMGMQTVFVFGDQDDMKENMGTYNSGYLTYGGSAYGNETFFPETFCMILHNGVQDAVIVFQRPEEDGDNLAMSEVLDGPLLEKYIELIKQQYGVRFFRKALSGFWTLSAIASGVNVLQVPGLSMKSIMEVFCVDYHHN

SEQ ID NO: 857 - protein, 526 aa, Coprinellus congregatus
MFKFAVLSQFVALALAAIGPQADLFIGNANVAPDGFQRSAALAGTDANSMVFPGPVIQAFKGETFNINVRNRLADPSMLRTTSIHWHGFFQAGSAWADGPVGVTQCPIAPNRDFLYTFATARQAGTFWYHSHHRSQYCDGLRGAMVVYDPEDPHRSLYDVDNEDTIITLADWYHPPGPVLETLNVATANSTLINGKGRYPTGPTTPLAVVGVTAGKRYRFRLVSISCSPFFTFSIDGHRMTIIEADGESTQPLVVDSIDIHAGQRYSFVLEANQPVANYWIRSNPNRGNRGFAGGLNTAILRYVGAPDADPVKPSDVDVPVPALPLVETNLHPLENPAAPGPPALGGEGVTAIELQIGLQGREWTVNGATFHEPNEPILLQTLNGKQMNELLPNQGSLFPIPRNSVIELTMPGGGAGSPHPMQLHGHMFSVIRSASNSTPNFVNPVRRDVVSLGSNTADRVTVRFVTDNAGPWIMHCHIDWHLVHGLSVVFVEDIEGISDSQRVAEDHPWRQLCPIYEQEKPDNEP

SEQ ID NO: 858 - protein, 528 aa, Kluyveromyces lactis NRRL Y-1140
MLSVRVNLKTRISSGMIRVNAPALKSTMPSVTSLTQLRFSTTVKPAPKLSLDDVNENVLKAKYAVRGRIPMRAEELRDQLKKDPSSLPFSKIISANIGNPQQLDQKPLTFYREVLSLLQHPELLEEADEALQTLYKTDSIKRAKRLLSEVGGSVGAYSQSQGVQGIRETVADFITKRDDGEISYPEDIYLTAGASAAVSYILSILCKGPNTGVLIPIPQYPLYTASLALNNSRPLPYYLREEQNWSTDPEEIEQVVLDAIQKGIKPTCLVVINPGNPTGAILSEQSIQKIFEVAAKYGIVVIADEVYQENVFKGSKFYSMKKVLRNLQKTYHGQYDNIQLASLHSTSKGVSGECGQRGGYMELVGFNHDIRQVFLKLASISLCPVVTGQALVDLMVSPPQPGDESYEQDQQEREDIHDALDERASKLFETFSRLEGIECRKPQGAMYLYPKLDLPYKVIQEAQHLEMEPDEFYCKALLENTGICTVPGSGFGQVPGTYHLRTTFLPPGTEWVETWEKFHKAFFDKYRD

SEQ ID NO: 859 - protein, 399 aa, Methanosarcina mazei Go1
MEKAEFRVSRIQSKQNSEDIIYGTLGGHNLKEIKFSENVSRIDTSGIRKIFEAAGSNAINLGLGQPDFDTPDHIKAAAIKAINEGFTGYTAGPGIPELREALSQKFKEENCFSVSPQEIIVTSGASEALTIALTALLNRGDEVLISNPGFVSYNALTEMLYGKVVNVPLGEDLTMKPEDVLERITPKTKAIILNSPSNPTGAVSSRADIKALAEIADDHRITIISDEVYEYFIYEGEHVSPASYSDNVVTVNATSKSYAMTGWRLGYLAARNEYISQMLKVHQYIQACANSIAQKAAYAAVTGPKDSVSAMREEFRKRRDVLVKGLNDLGMECALPKGAFYAFPRVSNSAEVASKMISNGVVVVPGTAFGSEGDGYIRISYAASMKDIEKSLSIMEKVL

SEQ ID NO: 860 - protein, 160 aa, Rhodopseudomonas palustris CGA009
MSVNVIFGSDAGATRAVASRIAKRLQGRAVDIKSATTTDFEACSLLILGAPTYGFGDLQTDWETNIDKLTSANLAGKKVALFGTGDQTNYPDSFVDAMGLLYDHVVERGADVVGFTETAGYDYTASKAERDGRFVGLALDEDGQSSKTEKRITEWISRLT

SEQ ID NO: 861 - protein, 546 aa, Psychrobacter arcticus 273-4
MMADDKTKSTQAERLVQLRRDKGMTAEQLAQAMTAAGAKVSRGAISNWERGTNGIVSSKLPTLARILGCSEGYLLRGELESDSKSDVDLKNIASDNTNVYVESDEQAHSASQITHTTTIPSTPRKISPNNLMSGPFMNTIKKSDKLQNVCYDIRGPLLQTANKMEAEGKRILKLNIGNPAPFGLEAPHEILRDVAMNLPEATGYSDSQGIFSARKAVLQYYQSKGLLSAVDVRDVYLGNGVSELIVMTLQALMNDGDEVLIPMPDYPLWTAATNLAGGTAVHYRCNEEDNWHPDIEDIKSKITSKTKGIVVINPNNPTGALYSDEVLLQIIEVAKEHDLIIMADEIYDRILYDDMEHTPMSTLTDEVLVLSYNGLSKSHRIAGFRAGWMMISGRKEHAADFIEGLDMLASMRLCSNVQGQYAIQTAMGGYQSMKDLTSKKGRLYKQRELAVTRLNAIKGISCTMPQGAFYCFPKMDPEIYPIKDDMQFMMDLLLEENVLMVQGTGFNWDKHDHFRLVFLPNLHDLEDAMDRLDRFFAKKRKQFGTD

SEQ ID NO: 862 - protein, 481 aa, Arabidopsis thaliana
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSNPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 863 - protein, 174 aa, Aeromonas hydrophila
MASVGLFFGSDTGNTEAVAKMIQKELGKQLIEVRDIAKSSKADIDSFDLLMFGIPTWYYGEAQADWDDFFPELEEIDFTNKLVAIFGCGDQEDYAEYFLDAMGTLRDIVEAKGAIVIGHWPTAGYEFEASKALVDDKHFVGLGIDEDRQPEMTAERVKGWCKQLHEEMCLAELE

SEQ ID NO: 864 - protein, 480 aa, Oryza sativa Japonica Group
MLRAAARALTVSSLNPKVLALADHHLGGLVARRAQLVTVTVNILIVERKKILQADTSMQQELDANPASHPFSEVLALCNHPHLLDRSEASFMFSSDAITRAREIVGFIPGKTTGGYSHCQANSIVSEFRSQMLTKYGNELSSNLTIFDRVHMMMHLLIRGKKDGILCPIPSHSLYTDSMVLRGATLVPYYLDESRGWSVNISDLKKQLDGARAKGIDVRGLVVVNPGNPTGQVLVEENQCEIVELCKNECLVLLADEVYQENIYTDQKKFNSFKKVARSIGYGEGDISLVSFHSVSNGYYGECGRRGGYMEVTGFSSEVRGEVYKVASLSACSNISGQILMSLVMNPPKVGDESYPSYRAERDSILSSLSCCAEAMVSTFNSMEGMTCNKAEGGISVFPSVRLPPRAIEAAEAMNTEPDVFYALRLLESTGIVVVPGSVFGQVPGTWHFRCTILPQEEKTRQIISRFNVFHEAFMEEFRS

SEQ ID NO: 865 - protein, 520 aa, Polyporus brumalis
MARFQSLLSYVTLLFVASAYAAIGPVTDLTVTDANISPDGFTRAGIVVNNVFPAPLITGQKGDRFQLNLVNQMSNHTMLKTTSIHWHGFFQKGTNWADGPAFVNQCPIASGNSFLYDFQVPDQAGTFWYHSHLSTQYCDGLRGPFVVYDPTDPHLSLYDVDDDSTVITLADWYHVAARLGPRFPLGADSTLINGLGRSTATPTADLAVISVTKGKRYRFRLVSISCDPNHTFSIDGHKLTVIEADGISTQPVTGIDSIQIFAAQRYSFVLTADQDVDNYWVRANPNFGTTGFAGGINSAILRYDGAPAVEPTTSQTGTNLLVETDLHPLSTMPVPGLPTQGGADFNLNLAFNFNGSDFFINGASFVPPTVPVLLQIISGANSAQDLLPSGSVYALPSNSSIELTFPATAAAPGAPHPFHLHGHAFAVVRSAGSTVYNYDNPVFRDVVSTGTPAAGDNVTIRFQTDNPGPWFLHCHIDFHLDAGFAVVFAEDLPDVVSANPVPQAWSDLCPIYNALDPSDQ

SEQ ID NO: 866 - protein, 524 aa, Polyporus brumalis
MSRFQSLVAFVALTLASSRLVAAAIGPVADLTISNADISPDGFTRAAVVVNNVFPGPLITGNKGDNFQLNVIDNLSNDTMLTATTIHWHGFFQKGTNWADGPAFVNQCPISTGNSFLYNFNAPDQAGTFWYHSHLSTQYCDGLRGPMVVYDDADPHASLYDVDDDSTVITLADWYHTAARLGPRFPVGSDSTLINGLGRFFGGVVDAPLSVFTVTSGKRYRSRLINISCDPNFTFTIQGHTLTVIEADAVSVQPYEVDSIQIYAGQRYSFVLTADQAVDNYWIQAIPNIGTVTTDGGVNSAILRYDGADIVEPAAATVTGSNPLVETSLVPLENLAAPGEPTVGGVDYPLNLDFSFDGTDFAINGATFTSPTVPVLLQIMSGAQDVADLLPSGSIYSLPSNATIELSFPITATNAPGAPHPFHLHGHTFYVVRSAGSTEYNYVNPPQRDTVSTGAAGDNVTIRFTTNNPGPWFLHCHIDFHLEAGFAVIFGEDIPAIADANPPSSAWEDLCPTYNSVYPNGDGN

SEQ ID NO: 867 - protein, 181 aa, Populus trichocarpa
MDCDWKKIVQPVMERYTETTDGSFIEPKESALVWHHQDADPDFGSCQAKELLDHLESVLANEPVVVRRGQQIVEVKPQGVSKGIVVENLISTMRSQGKSPDFLFCIGDDRSDEDMFESIARLVDNPSIPPIAEVFACTVGLKPSKAKYYLDDTPEVIKLLQGLATASVGSKYAHTLEDEDV

SEQ ID NO: 868 - protein, 624 aa, Cryptococcus neoformans var. neoformans
MRGLAKLFFLSCSFVSLVSSEKTDESPTAVSDNYMPKATATIDPSVFALSNDFEITDVPTTREYTFDIANAFASPDGYEREVYVVNNMFPGPVIEANTGDTIIVHVNNHLDEGQSLHWHGLRQLGTAFMDGVPGITQCPIPPGGSFTYNFTVSHQSGTYWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISIAPGERYSAIINTNEGKEGDAFWLRTSVALSCMFGAVSQEGLAVVRYTGNGMVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPARRSSSPSIQSSKTSSFQYLREVKGKVVKRRGAREA

SEQ ID NO: 869 - protein, 179 aa, Azotobacter vinelandii
AKIGLFFGSNTGKTRKVAKSIKKRFDDETMSDALNVNRVSAEDFAQYQFLILGTPTLGEGELPGLSSDAENESWEEFLPKIEGLDFSGKTVALFGLGDQVGYPENYLDALGELYSFFKDRGAKIVGSWSTDGYEFESSEAVVDGKFVGLALDLDNQSGKTDERVAAWLAQIAPEFGLSL

SEQ ID NO: 870 - protein, 896 aa, Saccharomyces cerevisiae YJM789
MTTTAQDNSPKKRQRIINCVTQLPYKIQLGESNDDWKISATTGNSALYSSLEYLQFDSTEYEQHVVGWTGEITRTERNLFTREAKEKPQDLDDDPLYLTKEQINGLTTTLQDHMKSDKEAKTDTTQTAPVTNNVHPVWLLRKNQSRWRNYAEKVIWPTFHYILNPSNEGEQEKNWWYDYVKFNEAYAQKIGEVYRKGDIIWIHDYYLLLLPQLLRMKFNDESIIIGYFHHAPWPSNEYFRCLPRRKQILDGLVGANRICFQNESFSRHFVSSCKRLLDATAKKSKNSSNSDQYQVSVYGGDVLVDSLPIGVNTTQILKDAFTKDIDSKVLSIKQAYQNKKIIIGRDRLDSVRGVVQKLRAFETFLAMYPEWRDQVVLIQVSSPTANRNSPQTIRLEQQVNELVNSINSEYGNLNFSPVQHYYMRIPKDVYLSLLRVADLCLITSVRDGMNTTALEYVTVKSHMSNFLCYGNPLILSEFSGSSNVLKDAIVVNPWDSVAVAKSINMALKLDKEEKSNLESKLWKEVPTIQDWTNKFLSSLKEQASSDDDMERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGIREKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 871 - protein, 624 aa, Cryptococcus neoformans var. neoformans
MRGLAKLFFLSCSFVSLVSSEKTDESPTAVSDNYMPKATATIDPSVFALSNDFEITDVPTTREYTFDIAKAFASPDGYEREVYVVNNMFPGPVIEANTGDTIIVHVNNHLDEGQSLHWHGLRQLGTAFMDGVPGITQCPIPPGGSFTYNFTVSHQSGTFWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISVAPGERYSAIINTNEGKEGDAFWLRTSVALSCMFGAVSQEGLAVVRYTGNGMVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPARRSSSPSIQSSKTSSFQYLREVKGKVVKRRGAREA

SEQ ID NO: 872 - protein, 172 aa, Vibrio cholerae O1 biovar eltor str. N16961
MKIGLFYGSSTCYTEMTAEKIRAILGEELVDIHNVKESPLTLMSDYDLLLLGISTWDFGEIQEDWSAVWDHIGGVSLKNKYVALFGLGDQEGYGEWYLDAMGLLHDQIKKSGANLLGYWPNQGYHFEASKALTEDGSHFVGLALDEDSQYDLSDERIATWVEQVLTEYHDAI

SEQ ID NO: 873 - protein, 496 aa, Coriolopsis gallica
AIGPVADLTISNGAVSPYGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGSIVVYDPQDPHKSLYDVDDDSTVITLADWYHLAARVGPAIPTADATLINGLGRSINTLNTDLAVITVTKGKRYRFRLVSLSCDPNHTFSIDGHSLTVIEAERVNLKPHTVDSIQIFAAQRYSFVLNADQDVDNYWIRALPNSGNTNFDGGVNSAILRYDGAAPVEPTTSQAPSTNPLVESALTTLEGTAAPGSPTPGGVDLALNMAFGFAGGRFSINGASFTPPTVPVLLQILSGAQSAQDLLPTGSVYSLPANADIEISLPATTAAPGFPHPFHLHGHAFAVVRSAGSSTYNYENPVYRDAVSTGTPGDNVTIRFRTDNPGPWFLHCHIDFHLEAGFAVVMAEDIPDVAATNPVPQAWSDLCPTYDALLPDDQ

SEQ ID NO: 874 - protein, 404 aa, Oceanobacter sp. RED65
MHEFHKSNKLANVLYDIRGPVLTAAKRMEEEGHRILKLNIGNPAPFELNAPDEIIQDVIHELPNAEGYSDSKGIYSARKAVMQYSQQKGIDGVEIDDIYLGNGVSELIVMALQALINNGDEVLIPAPDYPLWTGAVSLAGGTPRHYICDEQSNWYPDLDDIRAKVTPQTKAMVIINPNNPTGALYPKEVLEGMIEIARENNLVVFSDEIYDKIIFDEVEHTSTASLADDLLFITFNGLSKTYRLAGFRSGWLIVSGAKHKAKDYMEGLDMLANMRLCANVPAQYAIQTALGGYQSINDLIKPGGRIYEQRMTAHNMINDIPGLSCTLPQGALYSFIKMDQKRFNIKNDEKMVLDLLEQQKILIVHGRAFNWPEPDHFRLVFLPRVEDLEQAIEKMGHFFERYSQ

SEQ ID NO: 875 - protein, 624 aa, Cryptococcus neoformans A/D
MRGLAKLFFLSCSFVSLVSSEKTDESPTAVSDNYMPKATATIDPSVFALSNDFEITDVPTTREYTFDIAKAFASPDGYEREVYVVNNMFPGPVIEANTGDTIIVHVNNHLDEGQSLHWHGLRQLGTAFMDGVPGITQCPIPPGGSFTYNFTVSHQSGTYWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISVAPGERYSAIINTNEGKEGDAFWLRTSVALSCMFGAVSQEGLAVVRYTGNGMVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIENLTNIDFTLDNPVRKDTLWIQGGSWAVLRITADNPGVWALHCHIGWHLTEGKLAVIVVQPSAIGHMESPESWTNLCANTDPNAFGPAKRSSSPSIQSSKTSSFQYLREVKGKVVKRRGAREA

SEQ ID NO: 876 - protein, 613 aa, Phanerochaete chrysosporium
MAAAEDIAPEEKVALLEPHSNHDTQSASPRRRRPHAAHAALLAVFLLGVALLALGVWGTYASSPRGPSLPRELQRTPHTHFALDGLRGQPPQTRSHAFVVSEVEGAPDGVRKPMLVVNGMYPGPTIEANQGDRVVVKVTNMLENRTTIHWHGLFQNGTNYYDGTAAITECGIPPGQTLVYNFTLGEFSGTTWWHAHYSTQYTDGITGALVVHPTDPLPASIPPWDGDLVVQVSDLYHTFSPVLLERFLSPWGIDGVPGDEPVPDAGTLNGLGQWAGHGDYFNFTLEANKTYRLRVVNTGSFASVRFSVDRHVLRVVEADGTLVEPHDVSGVTLAVGQRYSVLLRTDNATGGPFWMRATLQKHMFRYDLPGQNRDIRGVIRYGPAADTTALPAETDDPGVRSHPGLADADDRQLVPALFNTAPERTRSYPLRVSLQLHDSLVMLGFLNTTSWEPLRGTTTLLRVREAFRAGGVYGGGDGGSLQDGEQFVLTEDSIQVVDLVIDNIDDGDHPFHLHGHRPWIVGSGVGRYIGQPLNATNPLRRDTVLVRAYSWMVLRFVTDNPGLWAFHCHLAWHMAAGMLMQVNSLPTRAAQLDIPQTIVDQCQVDVGGAGARR

SEQ ID NO: 877 - protein, 172 aa, Vibrio campbellii AND4
MKIGLFYGSTTCYTEMAAEKIRNIIGEDLVDIHNVKETPLSLMADYDLLLIGISTWDFGEIQEDWSAIWEDIAITPLKGKVVALFGLGDQEGYGEWYLDAMGLLHDELKVTGVQFIGYWPNEGYEFEASKALSEDGSQFVGLALDEDSQYELSDERIEKWCEQVLVEFHDTL

SEQ ID NO: 878 - protein, 474 aa, Klebsiella pneumoniae subsp. pneumoniae MGH 78578
MSRLVVVSNRIALPDDKKSSAGGLAVGILGALRAAGGLWFGWSGEIGDDQQPLKQVSRGNISWASFNLNERDHDEYYNQFSNAVLWPAFHYRLDLVSFQREAWEGYLRVNAMLADKLLPLIEPDDTLWIHDYHLLPFASELRKRGVNNRIGFFLHIPFPTPEIFNALPPHAELLEQLCDYDLLGFQTESDRTAFLDSIAMQTRLSDLGDKRYQAWGKAFSTEVYPIGIDPDEITRNAKGPLPPKLAQLKNELKNVKNIFSVERLDYSKGLPERFLAYETLLEKYPQHHGKIRYTQIAPTSRGDVQAYQDIRHQLETAAGRINGQFGQLGWTPLYYLNQHFDRKLLMKVFRYSDVGLVTPLRDGMNLVAKEYVAAQDPDNPGVLVLSQFAGAAQELTSALIVNPYDRDEVAAALDRALSMPLAERIARHSAMLDVIRENDIHNWQARFVEDLQHISPRSEESRLRGKIATFPKLA

SEQ ID NO: 879 - protein, 455 aa, Oryza sativa Indica Group
MRVSRLCNSTDIIAVNGQLPGPMIEVNEGDAVAVEVINGSPYNLTIHWYVTNPCASETSGEWWSRNVVDIESDAVSSGQLPRESDAFTVNGVTGELYQCANDTFTVDVQPNTTVLLRVINAGLNTHLFFKVAGHAFTVVAVDACYTANYTTDTLVLAPGHTVDALMVTNASAGSYYMAVQAYDSLSPTTMAVTDDTTATAIVRYNTTSTKKNATPVMPTMPQSSDSATANAFYFGLRGPPSPSAPAVPTKVDVNMTIELGLGQLPCDSTQSSCSGKSVAAAMNGVSFRLPSQMSLLEAQFNRTPGVYTADFPDAPQPSGTPMVEGTKVRRLKYNSTVEIVLQNPTAFPSENHPIHLHGFNFFVLAQGLGNFTPGNVSGYNLVDPVSRNTLAVPTGGWAVIRFVANNPGRNRTVAKSVVLLRPKLEMGCLGLTYGLKMTGLVLDFGRRHVVLPLPP

SEQ ID NO: 880 - protein, 412 aa, Burkholderia sp. 383
MKPIQKSNKLLNVCYDIRGPVLEHAKRLEEEGHRIIKLNIGNLAPFGFDAPDEIIQDMIRNLPTSSGYSDSKGVFSARKAVMHYTQEKGVVGVGLDDIYIGNGASELIVMATQALLNDGDEVLLPAPDYPLWTAAVSLSGGTPVHYICDEQNAWMPDPDDIRRKITPNTKAIVVINPNNPTGALYSDELLLELLAIAREHGLIVFADEVYDKIVYDGLEHTALGSLSEDVITVTFNSLSKSYRSCGYRAGWMAVSGLGGDNRRRAKDYLEGLGILSSMRLCANVPGQFAIQTALGGYQSINELIVPSGRLYKQRELAYDMLTSIPGVTCVKPQAALYMFPRLDPKLYPIQNDQQFILDLLLEERVLLVQGTGFNWTTPDHFRVVFLPNLDDLTDSINRIARFLDGYRKRHSA

SEQ ID NO: 881 - protein, 551 aa, Oryza sativa Indica Group
MASAAMLVPLVLVLCTAAASAAVVEHTFKVGGTKITQLCMNSVIYTANQQLPGPTIEVTEGDTLVVHAVNDSPYPLSLHWHGVYQLRSGWNDGANKITQCPIQPSGNFTYRFNITGQEGTLWWHAHSSLLRATIYGALIIKPRNGPSGYPFPEPYEEIPILLGEWWNRNVDDVENDGYLTGLGPQISDALTINGMPGDQNRCKGSAMYEVEVEYGKTCLLRIINAAVNVELFFKVAGHTFTVVAADASYTKPYATDVIVIAPGQTVDALMNTTASPGRYYMAAHVFDSKTVAVPFDQSTATGIVKYKGVPNYAPAAMPSLPPHDDVVTAGRFYWSLTGLARPSDPGVPTTVDHNMVVTFGLDQAPCAPNQTKCSGFALVAAMNRNSFQFPDQKVSLLEALYKGVPGVYSEDFPDFPSPMQGFRKATAVKKVKYNDVVEVVLQSEQYSSTLGTENHPIHLHGFDFYLLAQGLGRFNPSMKSKYNLVDPQVRNTVAVPAGGWAVIRFMANNPGEPAALNLFLPYMIWCNRASDCRVVELQLISDWFHASGMKL

SEQ ID NO: 882 - protein, 733 aa, Vitis vinifera
  misc_feature (660)..(660): Xaa can be any naturally occurring amino acid
MMSRSYTNLLDLASGNFPLMGQRKRLPRVMTVPGVISELDDDQANSVTSDVPSSIVQDRVIIVANQLPVKAKRRPDNKGWSFSWDEDSLLLQLKDGLPDDMEVLYVGSLRVDVDSNEQDDVSQVLLDRFKFDRSLWEAYVSANKIFSQRVIEVLNPEDDYVWIHDYHLMVLPTFLRRRFNRLRMGFFLHSPFPSSEIYRTLPVREEILKALLNSDLIGFHTFDYARHFLSCCSRMLGLEYQSKRGYIGLEYYGRTVGIKIMPVGVHMGQIESVLRFADKEWRVGELKQQFEGKTVLLGVDDMDIFKGVNLKLLAMEQMLTQHPKWQGRAVLVQIANPARGSGRDLEVIQAEIQASCKRINENFGQPGYEPIVFIDRPVSLSEKAAFYTIAECVVVTAVRDGMNLIPYEYIVSRQGVSGSESGSESSGPKKSMLVVSEFIGCSPSLSGAIRVNPWNVEATAEAMNEAISMADAEKQLRHEKHYRYVSTHDVAYWSKSFFQDMERSCKDHFRRWCWGIGLSFGFRVVALDPNFRKLSIDSIVSAYSRAKNRAILLDYDGTVMPQTSINKTPSEDVILILNTLCSDPRNTVFVVSGRGRDSLGKWFSPCNRLGIAAEHGYFLRWSVNEEWEICGQSNDFGWIQMAEPVMKLYTEATDGSYIEXKESALVWHHQDADPGFGSSQAKEMLDHLESVLANEPVAVKSGQFIVEVKPQDSKLSLKGTLYRCKELGMRRKT

SEQ ID NO: 883 - protein, 160 aa, Rhodospirillum rubrum ATCC 11170
MGTTVIYGSDGGTTQGVAKRIASPLQAKVVDIKVATTDDLEGCDLLILGAPTYGLGDLQCDWESRIGVLDSAKLTGKRVALFGTGDQIGYPDSFVDAMGILYDRVVALGATVVGFTATQGYDYSYSLAERDGQFVGLALDEDNQSSLTGKRIAAWVDHLK

SEQ ID NO: 884 - protein, 515 aa, Rhodococcus sp. RHA1
MAASSESSASSSRSTSDPVSGQADFVVVANRLPVDLERLPDGTTRWKRSPGGLVTALEPILRRNKGAWVGWAGVADAELDPVVEDDLELYPVPLSAAEIADYYEGFSNATLWPLYHDVIVKPEYNRDWWNAYVEVNRRFAEATSKAAAHGATVWIQDYQLQLVPKMLRMLRPDLTIGFFLHIPFPPVELFMQMPWRTEIIEGLLGADLIGFHLPGGAQNFLYLARKLAGQQTSRGNVGVRSKLGVVQVGFRTVRVGAFPISIDSGQLDEQSRSKSIRDRAKKIRNELGNPKHIMLGVDRLDYTKGIDVRLAALHELLDEQRIDPADTVMVQLATPSRERVDSYVQMRDDIERKVSRINGEYSEVGRPVVHYLHRPIPREELIAFFVAADVMLVTPLRDGMNLVAKEYVACRSDLGGALLLSEFTGAAAELRQAFLCNPHDLDSVKDAMEQALGQPKEDGRRHMRALRRQVLAHDVDRWARSFLDALAHGGAAGPALIAPAEASEADYNEDATGEN

SEQ ID NO: 885 - protein, 663 aa, Glycine max
MASAAPGATNDALYKELWHACAGPLVTLPREGERVYYFPQGHMEQASMNQGLEQQMPSFNLPSKILCKVVNVHLRAEPETDEVYAQITLLPEADQSEVTSPDDPLPESPRCTVHSFCKTLTASDTSTHGGFSVLRRHADDCLPPLDMTQQPPWQELVATDLHGNEWHFRHIFRGQPRRHLLTTGWSVFVSSKKLVAGDAFIFLRGENGELRVGVRRLMRQQSNMPSSVISSHSMHLGVLATASHAIATGTLFSVFYKPRTSRSEFIVSVNKYLEARSHKLSVGMRFKMRFEGDEVPERRFSGTIVGVGDNKSSVWADSEWRSLKVQWDEPSSILRPDRVSPWELEPLVSTPPTNPQPSQRNKRSRPPILPSTMPDSSLQGVWKSPVESAPFSYCDHQHGRDVYPSTNFNSTATGFLGFGGNCYASNKSIYWSSRMENSTESFSPVALKEFGEKRQGTANGCRLFRIQLHDNSNSNEESLPMVTLSGRMGDDGPLPSLDAESDQHSEPSNVNRSDIPSVSCDAEKSCLRSPQESQSRQIRSCTKVHMQGMAVGRAVDLTRFDGYEDLLRKLEEMFDITGELCGSTKKWQVVYTDNEDDMMMVGDDPWLEFCSIVRKIFIYTAEEVRKLSPKIGLPISEEVKPSKMDSEAVANPEDQSSIVGPGC

SEQ ID NO: 886 - protein, 403 aa, Fusarium proliferatum
ILQKGMPWEDGVPGVTQCPIPPKKSFTYQFLADLYGTSWYHSHYSAQVAAGLFGPLVIYGPREKKDYDIDIGPVMLSDWYHKEYFDLVEEIMKPGGNGVVLSDSNLINGKMNFNCSSVAPGDKTPCKSNAGISKFRFKRGKVHRLRLINPSAEAIQRFSIDGHTMKVIANDFVPVQPYDTKVVTLGVGQRTDVLVRANGKLDSYWMRSNISAICSLGRAPAALAAIYYDNANQKKAPKSQAWDIPDPETCANDDLSITKPVMKLPLPPADKTIELDISSFKNASNVTLWTLGGVAARTNYNSPTLLLSKLGNHTFEPEWNVINTGKAKSVRVVVNNKTPVAHPMHLHGFNMYVLHEGPGSWDGTIINRHNPQRRDVVQIRGNGHLVIQFDAGENPGVWPFHCH

SEQ ID NO: 887 - protein, 174 aa, Actinobacillus minor
MAAVGLFYGSDTGNTENISKMIQKELGANLVDIRDIAKSTKEDIEAYDFLMFGIPTWYYGESQADWDDFMPTLKEIDFNGKVVAIFGCGDQEDYAEYFCDAMGTVRDVVEPNGGVIVGLWPTDGYTFESSQALVDENTFVGLCIDEDRQPELTNERVKVWCKQLTEEMCLDQLA

SEQ ID NO: 888 - protein, 411 aa, Fusarium proliferatum
VHWHGILQKGMPWEDGVPGVTQCPIPPKKSFTYQFLADLYGTSWYHSHYSAQVAAGLFGPLVIYGPREKKDYDIDIGPVMLSDWYHKEYFDLVEEIMKPGGNGVVLSDSNLINGKMNFNCSSVAPGDKTPCKSNAGISKFRFKRGKVHRLRLINPSAEAIQRFSIDGHTMKVIANDFVPVQPYDTKVVTLGVGQRTDVLVRANGKLDSYWMRSNISAICSLGRAPAALAAIYYDNANQKKAPKSQAWDIPDPETCANDDLSITKPVMKLPLPPADKTIELDISSFKNASNVTLWTLGGVAARTNYNSPTLLLSKLGNHTFEPEWNVINTGKAKSVRVVVNNKTPVAHPMHLHGFNMYVLHEGPGSWDGTIINRHNPQRRDVVQIRGNGHLVIQFDAGENPGVWPFHCHIDS

SEQ ID NO: 889 - protein, 416 aa, Streptococcus pyogenes MGAS10394
MVYNMEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 890 - protein, 407 aa, Polaromonas sp. JS666
MKPITKSAKLANVLYDIRGPIMDAAKQMEEEGHHLIKLNLGNLAVFGFDAPEEIQQDMIRNLPSSAGYSDSKGIFAARKAVMHETQKQGISGVTLDDIYLGNGASELIAMATNALLDDGDELLLPTPDYPLWTASTSLSGGKPVHYLCDEDNGWMPNLDDIRAKITPKTKGIVVINPNNPTGALYSDELLKQIVEIARTHGLVILADEVYDKVLYDGAHHTAIASLSTDVLTLTFNSLSKSYRSCGYRAGWLVVSGPKKRAEDYIEGLNMLANMKLCSNVPGQWAIQTALGGYQSINDLTGEGGRLRRQRDLAYELITAIPGVSCVKPSAALYMFPKLDPKVYPIKDDRQFFLELLKETKVMLVQGTGFNWASPDHFRIVFLPHEEDLREAVGRIAKFLENYRNNNI

SEQ ID NO: 891 - protein, 615 aa, Cryptococcus bacillisporus
MRGIVNFLFLSCSLIPLVISENTGKLPTATIDPSVFALSNDFEVSDVPTTREYTFDISKALASPDGYERVVYTVNNMFPGPVIEANTGDTIIVHVNNHLDEGQGIHWHGMRQKNSPYMDGIPGITQCPIPPGGSYTYNFTISDQSGTYWWHSHYSNAMADGLWGPLIVHSVHEPIQRGRDYDEDRIVFVSDWMHDNSEIIIAALATPAGYKGNPAPPQGDSILINGRGQTNCTATNSSSCYYPAPPEIHVPVNSRVRLRFISATAHPMYRISLDNHPLEIVETDGTAVYGPTVHEMSIAPGERYSAIINTSEGKEGDAFWLRTSVALGCMFGGVPQVGLAVVRYTGNEMTTTAEPQSYAWSDLANATALCAGLDQTYTLSPRERESCRVSRASSQSHIFNSQRGAFVNYLGNTFQGYGFNNISYQNKIFNPLLSIVQRGDPYESTLVASTTFPDMGVGAIIINNLDGPIDHPYHLHGNEFQVIGRGTGALSLDNLTNIEFNLENPVRKDTLWIQGGSWAALSIVTDNPGVWALHCHIGWHLTEGKLAVVVVQPNAVGQIACPESWTNLCANTDPNAFGPARRSSSPSIQSSKTSVFQHLREVKGNFVKRRGARET

SEQ ID NO: 892 - protein, 624 aa, Cryptococcus neoformans var. grubii
MRGVVKLFFLSCSLVSLVSSEETGKSPTANYDHYMPKATATIDPSVFALSNDFEITDVPTTREYTFDITKALASPDGYEREVYVVNNMFPGPVIEANTGDTIIVHVNNHLEEGQSIHWHGLRQLGTAFMDGVPGITQCPIPPGSSFTYQFTVSHQSGTFWWHSHYSNSMADGIWGPLIIHSPNEPLQRGRDYDEDRIVFITDWVHDNSEVVIAALATPEGYKGSPAPPQGDAILINGRGQTNCTATGSSSCTYPPPPEIHVPVNCRVRLRFISATAHPMYRITIDNHPLEVVETDGTAVYGPTVHEISIAPGERYSAIINTSEGKEGDAFWLRTSVALGCMFGGIDQVGLAVVRYTGNGMVSTEEPQTTAWSDLAGATTPCAGLDQTYTLSPRESFSAPREFSQSHVFNSQRGAFVNVYGNTFQGYGFNNISYQNQIFNPLLSIVQRGGSCESTLVASTTFPDLGSGNIIINNLDGVIDHPYHLHGNEFQVIGRGTGALSLDNLTNIDFNLDNPVRKDTLWIQGGSWVVLRITTDNPGVWALHCHIGWHLTEGKLAVVVIQPGAIGHMEGPESWTNLCANTDPNAFGPARRSPSPSIQSSKTSTFQYLREVKGKVVKRRGAREA

SEQ ID NO: 893 - protein, 870 aa, Zostera marina
MMSRSYTNLLDLASGNFPVISGGGRDGRSGGMRRMPRVMTVPSNIAELEDEQASSVASDVQSSIIQDRLIIVGNQLPVVAKRRSDNAGWDFSWDDESLLLQLKDGLPDDMEVLYVGCLRVIVDPEEQDDVSQTLLEKFKCVPAFLTEEILEKYYHGFCKKLLWPLFHYMLPLTKDHGGRFDRSLWEAYVAVNKIFSQKVVEIISPEDDYVWIHDYHLMVLPTLLRRRFIRLRMGFFLHSPFPSSEIYRTLPVREEILNSLLCSDLIGFHTFDYARHFLSCCSRMMGLEYQSKRGYISLDYFGRTVGIKIMPASIHLGQLESMLKTVYKESKIEELERQFQGKTVILGVDDMDIFKGINLKLLAFEQMLKLRPNWQGRAVLVQIANPARGRGKGLESVEVEIRDICERINQQFGRVGYKPVVYINRSVSLKERIAYYTIAECVVVSAVRDGMNLIPYEYTVCKQGIAEPESDSLFADPKKSMLVVSEFIGCSPSLSGAIKINPWNSEATAEAMSDAISMPDGEKQLRHGKHYRYVRTHGVSYWSKSFMQDMERTCKDHFKRRCWGIGFGFGFRVVALDPNFKKLNVDSIVFSYERAKSRAILLDYDGTMINPLSINKTPSTEVISILNALSKDKKNVVFMVSGRGRESLGSWFSSCEKLGIAAEHGFFMRWGRDDEWTTWDKNKDFGWMLMADPVMKLYTEATDGSYIEAKESALVWHHRDADQTFGTSQAKEMLDHLENVLANEPVIAKRGQFIVEVKPQGVSKGLVADNILSTMAKRNCPADFVLCIGDDRSDEDMFENFGSKNLVSFNAHIYSCTVGQKPSKATYYLDDTNDVLEMLRALADASEEDDDDEEEIEDDYVDDESEEGSS

SEQ ID NO: 894 - protein, 173 aa, Shigella flexneri 2a str. 301
MNMGLFYGSSTCYTEMAAEKIRDIIGPELVTLHNLKDDSPKLMEQYDVLILGIPTWDFGEIQEDWEAVWDQLDDLNLEGKIIALYGLGDQLGYGEWFLDALGMLHDKLSTKGVKFVGYWPTEGYEFTSPKPVIADGQLFVGLALDETNQYDLSDERIQSWCEQILNEMAEHYA

SEQ ID NO: 895 - protein, 870 aa, Zostera marina
MMSRSYTNLLDLASGNFPVISGGGRDGRSGGMRRMPRVMTVPSNIAELEDEQASSVASDVQSSIIQDRLIIVGNQLPVVAKRRSDNAGRDFSWDDESLLLQLKDGLPDDMEVLYVGCLRVIVDPEEQDDVSQTLLEKFKCVPAFLTEEILEKYYHGFCKKLLWPLFHYMLPLTKDHGGRFDRSLWEAYVAVNKIFSQKVVEIISPEDDYVWIHDYHLMVLPTLLRRRFIRLRMGFFLHSPFPSSEIYRTLPVREEILNSLLCSDLIGFHTFDYARHFLSCCSRMMGLEYQSKRGYISLDYFGRTVGIKIMPASIHLGQLESMLKTVYKESKIEELERQFQGKTVILGVDDMDIFKGINLKLLAFEQMLKLRPNWQGRAVLVQIANPARGRGKGLESVEVEIRDICERINQQFGRVGYKPVVYINRSVSLKERIAYYTIAECVVVSAVRDGMNLIPYEYTVCKQGIAEPESDSLFADPKKSMLVVSEFIGCSPSLSGAIKINPWNSEATAEAMSDAISMPDGEKQLRHGKHYRYVRTHGVSYWSKSFMQDMERTCKDHFKRRCWGIGFGFGFRVVALDPNFKKLNVDSIVFSYERAKSRAILLDYDGTMINPLSINKTPSTEVISILNALSKDKKNVVFMVSGRGRESLGSWFSSCEKLGIAAEHGFFMRWGRDDEWTTWGKNKDFGWMLMADPVMKLYTEATDGSYIEAKESALVWHHRDADQTFGTSQAKEMLDHLENVLANEPVIAKRGQFIVEVKPQGVSKGLVADNILSTMAKRNCPADFVLCIGDDRSDEDMFENFGSKNLVSSNAHIYSCTVGQKPSKATYYLDDTNDVLEMLRALADASEEDDDDEEEIEDDYVDDESEEGSS

SEQ ID NO: 896 - protein, 613 aa, Cryptococcus bacillisporus
MRGIVNFFFLSCSLILLVSSENTGKLPTATIDPSVFALSNDFEVSDVPTTREYTFDITKALASPDGYEREVYTVNNMFPGPVIEANTGDTIIVHVNNHLDKGQSIHWHGMRQKDTPYMDGVPGITQCPIPPGGSYTYNFTISDQSGTYWWHSHYSNAMADGLWGPLIVHSVHEPIQRGRDYDEDRIVFVSDWLHDDSEIIIAALATPAGYRGSPAPPQGDSILINGRGQTNCTATNSSSCYYPAPPEIHVPVNSRVRLRFISATAHPMYRISLDNHPLEIVETDGTAVYGPTVHEMSIAPGERYSAIINTSEGKEGDAFWLRTSVALGCMFGGVPQVGLAVVRYTGNEMTTAEPQSYAWSDLANATALCAGLDQTYTLSPRERESCRVSRASSQSHIFNSQRGAFVNYLGNTFQGYGFNNISYQNKIFDPILSMVQRGDPYESTLVASTTFPDMGAGAIIINNLDGPIDHPYHLHGNEFQVIGRGTGALSLDNLTNIEFSLDNPVRKDTLWIQGGSWAALSITTDNPGVWALHCHIGWHLTEGKLAVVVVQPNAVGQIACPESWTNLCANTDPNSFGPARRSPSPSIQSSKTSAFQRLREVKGNVKRRGAREV

SEQ ID NO: 897 - protein, 469 aa, Yarrowia lipolytica CLIB122
MPNVLVISNRLPVTISREEDGTYKYTMSSGGLVTALSGLKQSTTFQWFGWPGLEIPEKDKPRLINDLETMFSCVPVFMDDDLADLHYNGFSNSILWPLFHYHPGEMNFDQVAWEAYTQANRLFAKKVASIVKPGDIVWVHDYHLMLLPEMLREECENNSALDGLKIGFFLHTPFPSSEIYRILPVRKEVLTGVLSCNLIGFHTYDYARHFLSSVSRILDLETMPNGTYYKGRHVVVGAFPIGIDVNKFLEGCKRPAVQERIAQLQDKFKGIKVVVGVDRLDYIKGVPQKLHAFEVFLSEHPEWIGKVVLVQVAVPSRGLVEEYQNLRAVVNELVGRINGMFGTVEFTPIHFMHRSVDFNELIALYSISDVCFVSSTRDGMNLVSYEYVACQTEKHGSLILSEFTGAAQSLNGALIVNPWNTEDMAEALYDSLTFSPEKKAENHRKLFKYVSKYTSQHWGEAFVSELKRC

SEQ ID NO: 898 - protein, 393 aa, Desulfitobacterium hafniense DCB-2
MGGKVLKARRLSSLGASVFTEMDDLRKELEKAGKQLINLSIGSPDRSPSAEIRKVLAEGVLDGGSYGYTLTRGTESFRSGCARWYKERFGVNLDPEKEVLPLMGSQDGLAHIFLALCDPGDVALIPDPGYPIYTAGLVLAGGEKVALPLREENGFLPDLSAIEDEVAQQAKIMFLNYPNNPTAAVAPLSFFEEVVDFARRNRIVVCHDAAYSELAFDGYRPVSFLQVPGAKEVGIEFHSVSKTYNLAGVRLGFAVGNGEIIGALAELKSNIDYGVFEPALQAGAYALSASQENVEQNRRAYQERRDIWVKGCAQAGWSMPSPRGSMFIWAPVPTAQDSRSFAFALAREAGVIVVPGVAFGEYGEGYVRIGMVQDQEVLQEAVRRVQEFLAAQG

SEQ ID NO: 899 - protein, 579 aa, Cucurbita cv. Ebisu Nankin
MLQMGKAREPNFLILFFFGLILAFGISSEGSQIRHYKWEVEYMFWAPDCNENIVMGINGQFPGPTIRANAGDTVVVELINKLHTEGVVIHWHGILQRGTPWADGTASISQCAINPGETFFYNFTVDNPGTFFYHGHLGMQRSAGLYGSLIVDPPQGKKEPFHYDGEINLLLSDWCHQSIHKQEVGLSSKPIRWIGEPQTILLNGRGQFDCSIAAKYDSNLEPCKLKGSEPCAPYIFHVMPKKTYRIRIASTTALAALNFAIGNHPLLVVEADGNYVQPFYTSDIDIYSGESYSVLITTDQNPSENYWVSVGTRGRHPNTPPGLTLLNYLPNSVSKLPTSPPPETPAWDDFDRSKNFTYRITAAMGSPKPPVKSNRRIFLLNTQNVINGYVKWAINDVSLALPPTPYLGAMKFNLLHAFDQNPPPEVFPEDYDIDTPPTNEKTKIGNGVYQFKIGEIVDVILQNANMMKENLSEIHPWHLHGHDFWVLGYGDGKFTAEEESSLNLKNPPLRNTVVIFPYGWTAIRFVADNPGVWAFHCHIEPHLHMGMGVVFAEGVEKVGRIPTKALACGGTAKSLINNP

SEQ ID NO: 900 - protein, 256 aa, Zea mays
  misc_feature (175)..(175): Xaa can be any naturally occurring amino acid
  misc_feature (193)..(193): Xaa can be any naturally occurring amino acid
  misc_feature (209)..(209): Xaa can be any naturally occurring amino acid
RTLSLRLKVKIIRYAPCGEIVKHASRLEQEIEENPASIPFQEIIYCNLGNPQVLGQPPLTFFREVLSLCDNPALMDRDEARALFSPCSIRRARRILNSIPSKDTGGYTDCRGIKCLRQVVADGITARDGFPSTADDIFLTDGATSAINLMMQILIRSHEDGILSPLPEYPLYSAXIILHGGTMVPYNLTEDNXWGLEIFEVKRCLEEAXSAGLTGRAMVVINPGNPTGQVYQENIYAENKKFHSFKKGARSLAYDE

SEQ ID NO: 901 - protein, 537 aa, Oryza sativa; identical to SEQ ID NO: 372

SEQ ID NO: 902 - protein, 170 aa, Picea sitchensis
MINKSKMRKPNAPELETSPLHSTRHCAYPDIRGRHRKQVELNRLTKEISLLEEELKTLEGLPPSSKCCKGVVESIEKRPDPLLPFVTRGQAISSWDRWFKERSINSNCSCCCSCKHVKIWKFSYWKRFICWKLTFRKACCVFPRFSCHKCCCFQCSCAGCIKCCPLCKNK

SEQ ID NO: 903 - protein, 481 aa, Arabidopsis thaliana
MSLKALDYESLNENVKNCQYAVRGELYLRASELQKECKKIIFTNVGNPHALGQKPLTFPRQVVSLCQAPFLLDDPNVGMIFPADAIARAKHYLSLTSGGLGAYSDSRGLPGVRKEVADFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCCDERLVLLGDEVYQQNIYQDERPFISSKKVLMDMGAPISKEVQLISFHTVSKGYWGECGQRGGYFEMTNIPPRTVEEIYKVASIALSPNVSAQIFMGLMVSPPKPGDISYDQFVRESKGILESLRRRARMMTDGFNSCKNVVCNFTEGAMYSFPQIKLPSKAIQAAKQAGKVPDVFYCLKLLEATGISTVPGSGFGQKEGVFHLRTTILPAEEEMPEIMDSFKKFNDEFMSQYADNFGYSRM

SEQ ID NO: 904 - protein, 515 aa, Trametes hirsuta
MSRFQSLLTFITISLVAVAHAAVGPVADLTITDAAVSPDGFSRQAVVVNGVTPGPLVAGNIGDRFQLNVIDNLTNHTMLKSTSIHWHGFFQHGTNWADGPAFINQCPISPGHSFLYDFQVPDQAGTFWYHSHLSTQYCDGLRGPFVVYDPNDPHASRYDVDNDDTVITLADWYHTAAKLGPRFPGAADAVNINGKGRAPVTLPASCSVIKVTKGKRYRFRLVSLSCNPNHTFSIDGHNLTIIEVDSVNSQPLEVDSIQIFAAQRYSFVLDANQAVDNYWIRANPNFGNVGFDGGINSAILRYDGAPAVEPTTNQTTSVKPLNEVDLHPLVSTPVPGASDKAINMAFNFNGSNFFINGASFVPPTVPVLLQILSGAQTAQDLLPSGSVYVLPSNASIEISFPATAAAPGAPHPFHLHGHTFAVVRSAGSTVYNYDNPIFRGVVSPGTPAARDNVTIRFDTNQPGPWFLHCHIDFHLEGGFAVVMAEDTPDVQAVNPVPQAWSDLCPTYDALDPNDQ

SEQ ID NO: 905 - protein, 591 aa, Phanerochaete chrysosporium
MDQSAYSRFGRANHARRRLNLCLRPAPVYLPLLLALLAIAFVTSVDARAVSYASRDTPELASHEATVAVPRADNFVVGSIRGQPPTTRHFNFVVSQMNGSPDGFSKPMLVVNGLFPGPTIEANQGDRIVVHVTNTLSTRTTIHWHGLYQNSTNYYDGTAGVTECGIPPGQSLTYNFTVDDFSGTTWWHAHYDTQYTDGVTGALIVHPRKYPRGFPTWDEDIVVELTDIYHAFSETILSEYLGGGGGPLTGLQLETPDSGAINGIGQYNGSTKYTNLNLKPNKTYRLRLIHTGSAAAIRFSVDYHALTVIEADSTLTQPYTVSSVTLAVAQRYSVLLTTNQHAEPARNYWMRAALKSAVAVPGANADIRGILRYGSGHAAPTAGADPGVPGSGLADLDVAKLVPAAPRTPPPATKAYTVDFSIGGKPDGGAFATMNGTSWQPLQGTTTLLQIVDAARNGSMYAPEGASIQPGGQFLITEDNIEVVDVLLVNTGPGDHPFHLHGHTPYIMGFGTGAYTGTGLNTVNPFMRDTFAVPGSGWLLMRIVTDNPGIWTLHCHIAWHMAAGLMMQISSLPSKAAQLDIPRDIVRQCSA

SEQ ID NO: 906 - protein, 398 aa, Fusarium proliferatum
MYQNGTNFMDGPAMVTQCNIPTGASITYNFTVDQVGTYWYHSHTRSQYPDGLRQALIIQDPKNPYEGEYHEERVITLSDWYHDEMPVLMKQFVSYKNPTGAEPVPNSALMNDTQNMTLPVEPGKTYLLRLVNVGAFASQYFWIEGHTMKIVEVDGVWTKPAETDMIYIASAQRYAVLVTMKNETGVNYPMMASMDTTLFDTIPDGLNWNVTGWLEYDTDKKLPAAAVLNDFEPYDDFKLVPTDGEKLLEKADHTISLDLTMNNLGDGANYAFFNDISYVSPKVPTLYTVLSAGENATNPTVYGTDTNSFVLKHGEIVEIILNNDDSGRHPFHLHGQNFQVVHRSEENAGHYNASWTNITYPSVPMRRDTLLVYPQGNFVIRFPATNPGVWLFHCHIAC

SEQ ID NO: 907 - protein, 485 aa, Corynebacterium glutamicum ATCC 13032
MDDSNSFVVVANRLPVDMTVHPDGSYSISPSPGGLVTGLSPVLEQHRGCWVGWPGTVDVAPEPFRTDTGVLLHPVVLTASDYEGFYEGFSNATLWPLFHDLIVTPVYNTDWWHAFREVNLKFAEAVSQVAAHGATVWVQDYQLLLVPGILRQMRPDLKIGFFLHIPFPSPDLFRQLPWREEIVRGMLGADLVGFHLVQNAENFLALTQQVAGTAGSHVGQPDTLQVSGEALVREIGAHVETADGRRVSVGAFPISIDVEMFGEASKSAVLDLLKTLDEPETVFLGVDRLDYTKGILQRLLAFEELLESGALEADKAVLLQVATPSRERIDHYRVSRSQVEEAVGRINGRFGRMGRPVVHYLHRSLSKNDLQVLYTAADVMLVTPFKDGMNLVAKEFVANHRDGTGALVLSEFAGAATELTGAYLCNPFDVESIKRQMVAAVHDLKHNPESAATRMKTNSEQVYTHDVNVWANSFLDCLAQSGENS

SEQ ID NO: 908 - protein, 405 aa, Fusarium proliferatum
ASVHWHGMYQNGTNFMDGPAMVTQCNIPTGASITYNFTVDQVGTYWYHSHTRSQYPDGLRQALIIQDPKNPYEGEYHEERVITLSDWYHDEMPVLMKQFVSYKNPTGAEPVPNSALMNDTQNMTLPVEPGKTYLLRLVNVGAFASQYFWIEGHTMKIVEVDGVWTKPAETDMIYIASAQRYAVLVTMKNETGVNYPMMASMDTTLFDTIPDGLNWNVTGWLEYDTDKKLPAAAVLNDFEPYDDFKLVPTDGEKLLEKADHTISLDLTMNNLGDGANYAFFNDISYVSPKVPTLYTVLSAGENATNPTVYGTDTNSFVLKHGEIVEIILNNDDSGRHPFHLHGQNFQVVHRSEENAGHYNASWTNITYPSVPMRRDTLLVYPQGNFVIRFPATNPGVWLFHCHIAC

SEQ ID NO: 909 - protein, 455 aa, Xanthomonas campestris pv. campestris str. ATCC 33913
MSRLVVVSNRVAVPGESRAGGLAVGLLAALKERGGVWFGWSGKTVRGDSGGMHEQTDGDIKFVTMDLNKRDIDSYYNGFANRTLWPLLHFRLDLVDYDRATREGYLRVNRLFAEKLAPLLKDSDTLWIHDYHMIPLGAMLRELGVGCKMGFFLHVPMPSADLMQAMPDHARLFSTFYAYDLVGFQTQRDAERFKAYVRLFGGGRVLEGDLVEGPGGRRFSAAAFPIGIDTDLIANQAKASVSKQAVRDLRESLRGRQLAIGVDRLDYSKGLPERFQGFERYLERYPDQSGSLTYLQIAPVSRGDVNEYRQLRGQLEQIAGHINGGHAEPDWTPLRYVNQNFSHATLTGFYRAAAVGLVTPLRDGMNLVAKEFVAAQDPENPGVLVLSLLAGAADEMKEALLVNPHDLDGVADAIATAASMPLATRVERWHAMMDHLRKNNINHWRQRYLQALADI

SEQ ID NO: 910 - protein, 474 aa, Burkholderia cenocepacia J2315
MSRLIVVSNRVAAGEDTRPSAGGLAVGVMDALRETGGVWFGWNGEIVGAPDAEPAIQRDGNVTYATVGLTRRDYDQYYRGFSNATLWPVFHYRGDLARFDRQEYAGYLRVNAMLAKQLAALLRPDDLIWVHDYHLLPFAHCLRELGVKNPIGFFLHIPFPSPDMLRLVPPHEELVKFMCAYDVAGFQTEADKQAFTDYIERRGIGAASDDDGMLHAHGRVVKVAAYPIGVHPDAIAQAAVQYGTRKPVKMLREALGDRKLVMSVDRLDYSKGLVERFQSFERMLANAPGWQGRVSLLQIAPPTRSDVQTYQHIRETLEGEAGRINGRFSQLDWTPIQYLNRKYERNLLMAFFRMSQVGYVTPLRDGMNLVAKEYVASQDPADPGVLVLSEFAGAAAELTGALLVNPYDLSQMAEALERALSMPLAERQARHEENLARLRENDLSVWRDTFVADLRSVAAAASVTRRAGRRVAHA

SEQ ID NO: 911 - protein, 559 aa, Zea mays
MHRFAADRARRAVAASLRGAASRAAAAPSRHAPAPRHPTSPVGAAAPVAAAAMARAAMSTAVAGVPPPVSLDTISPKVPPVSLDTINPKVLKCQFAVRGEIVTRAQKLQQELQRNPESLPFDEILYCNIGNPHSIGQQPVTYFREVLSLCENPALLDKSETHALYRSDAIERARKILDKIPGRATGAYSHSQGIKGLRDEIAAGIAARDGFHASADNIFLTDGASPAVHMILQLLIRSEKDGILCPIPQYPLYSASIALHGGSLVPYFLDEETGWALEVDELKKQLEEARSKGISVRALVVINPGNPTGQVLTEENQKKIVEFCKNERLVLLADEVYQENIYVEDKQFHSFKKIARSLGYTDDDLPLVSFQSISKGYYGECGKRGGYMEITGFSPQVRDQIYKMASINLCSNITGQILASLVMNPPKAGDESFESFRLERDGILSSLGRRAKALEEAFNSLEGITCNKAEGAMYLFPRLHLPQKAIGAAQAAGTAPDAYYAKRLLEATGIVFVPGSGFGQVPGTWHIRSTILPQEDKIPGIVSRFKEFHDKFMDEFRDY

SEQ ID NO: 912 - protein, 673 aa, Oryza sativa
MAAAMEMAANPGGSGTCSDALFRELWHACAGPLVTVPKRGERVYYFPQGHMEQLEASTNQQLDQYLPMFNLPSKILCSVVNVELRAEADSDEVYAQIMLQAEADQSELTSLDPELQDLEKCTAHSFCKTLTASDTSTHGGFSVLRRHAEECFPQLDMSQNPPCQELVAKDLHGTEWHFRHIFRGQPRRHLLTTGWSVFVSSKRLVAGDAFIFLRGESGELRVGVRRLMRQVNNMPSSVISSHSMHLGVLATASHAISTGTLFSVFYKPRTSRSEFVVSVNKYLEAKKQNLSVGMRFKMRFEGDEAPERRFSGTIIGIGSVPAMSKSPWADSDWKSLKVQWDEPSAIVRPDRVSPWELEPLDASNPQPPQPPLRNKRARPPASPSVVAELPPSFGLWKPPSEAAQTLSFSEPQRAREIFPSARGSIFSASSHVEFNSKNEPSRVSNQFYWSMRDSKTDSFSASTNKARVERKQEPTTMGCRLFGIEISSAVEEALPAATVSGVGYDQTVLSVDVDSDQISQPSNGNKSDAPGTSSERSPLESQSRQVRSCTKVIMQGMAVGRAVDLTKLNGYGDLRSKLEEMFDIQGDLCPTLKRWQVVYTDDEDDMMLVGDDPWDEFCSMVKRIYIYSYEEAKLLAPKSKLPVIGDTIKLSSMNSSHESVDLDNHASVTNRDC

SEQ ID NO: 913 - protein, 1148 aa, Kluyveromyces lactis NRRL Y-1140
MVVIIASLFLPFQPQFEIHSSSVETASLVDQPVKIRNAGSGVKSSANSLYSGNPFDLGTSLTRKRSSSSHSRSSFAPLDLTMSAASGGDGMESSPAPSGEFSNQHRLDEVTKPVGANPQISSESFMESLTGKAHSAAASSSKNALSNYPTGSVEEFFSSGNTQLGKNYDNNTGSPDSTYSIQSSPVISAVNPTHDSTSNLLKNVNKSLLYQIVLNESNSASALEGTSKHFWNSPGSTVITPRSRALPDVNSSLSGVAKGKGHLHIKSQAPAIRHVHPAAQGPGNVTGTTGGGGGGSSKLKYSVNANHDEDSQEEKYEQSEQEEGEEENDENENVVDDEDEDMYDIEELDSSGRYHYNVPKFGGYSNKAKLKNALLKKSENIFSTAPWTIVPCAKGNGGLKNAVATALLEKTIDEQVTWVGTVGIPTDCIPEKTLDNICHELYTNYHSRAVISDDLTFKGAYKNFCKQILWPTLHYQIPDNPNSKAFEDHSWNYYQHLNQLFANEIVKTYKEGDIVWVNDYHLMLVPEMVREKLPDAKIGFFLHISFPSSEVFRCFPQREKILNGILGANSVGFQTDEYARHFMQTATRLLMTDADDHQLKLQGRVVKVNNTPIGVDVFNLDEQIDTEQVIQWRKLIRERWSDKRLIVCRDQFDRIRGLKKKMLAYERFLKENPEYVDKVVMIQICLDTARDIDLERDIMSVVDRINALSKDISISQPVVFLHQDLEFSQYLALNCEADLFIVSSMREGMNLTCHEFVVCSRERNAPLLLSEFTGSTQILKSGALLINPWDIKKFARAIKIGLEMPPDEKRRRWKKMFKSVINHDSDNWIVHALNNIDSSWEFNHERSQVFNLSFKQMYAAYSQAKRHMFVLKISEPPTPRMLRILSELSANNIVYLMNSNSRGVLERLYSRVSNVGLIAENGAYVRLNGNWFNIVEDVSWKDDVIKVFEDKMERLPGSYCKIGDSMVRFHTENAEDRDRVQGVIGEAMTHINTLFSDKGIHAYVNKNIVFVQEVGLALKTLQFLVSYYNSVDDISCSSHSPVAQPTSAETSASPLLSPISPKNGAGFFHVAAKRENRDPIGFLTITGSTSPVIEPLFQYVNELTKEGKLQYGYSVVHGDTSSTYAKEHIQGLNELFSMLQKLSSPNSS

SEQ ID NO: 914 - protein, 499 aa, Synechocystis sp. PCC 6803
MNSSLVILYHREPYDEVRENGKTVYREKKSPNGILPTLKSFFADAEQSTWVAWKQVSPKQKDDFQADMSIEGLGDRCTVRRVPLTAEQVKNFYHITSKEAFWPILHSFPWQFTYDSSDWDNFQHINRLFAEAACADADDNALFWVHDYNLWLAPLYIRQLKPNAKIAFFHHTPFPSVDIFNILPWREAIVESLLACDLCGFHIPRYVENFVAVARSLKPVEITRRVVVDQAFTPYGTALAEPELTTQLRYGDRLINLDAFPVGTNPANIRAIVAKESVQQKVAEIKQDLGGKRLIVSAGRVDYVKGTKEMLMCYERLLERRPELQGEISLVVPVAKAAEGMRIYRNAQNEIERLAGKINGRFAKLSWTPVMLFTSPLAYEELIALFCAADIAWITPLRDGLNLVAKEYVVAKNGEEGVLILSEFAGCAVELPDAVLTNPYASSRMDESIDQALAMDKDEQKKRMGRMYAAIKRYDVQQWANHLLREAYADVVLGEPPQM

SEQ ID NO: 915 - protein, 404 aa, Marinobacter sp. ELB17
MQNYHKSTKLDNVCYDIRGVVLREARRLEEEGHRVLKLNIGNPASFELDVPEEIQQDVIYNMHLAQGYVESKGLFSARKAVMHYCQQRGIDKVDIDDIYLGNGVSELIVMSMQAMLNTGDEVLIPAPDYPLWTAAVALSSGKPVHYHCDEQQGWFPDIDDIRRKITKRTRAIVLINPNNPTGAVYSTEVLHQVIELARAHNLIILSDEIYDKILYDGVTHVSTASLADDVLFFTYNGLSKNYRAAGYRSGWMIISGAKHKATDLVEGIEMLSNMRLCANVPAQLAIQTALGGYQSINDLVIPGGRLFEQRQAAWELLNDIPGVSCVKPQGALYLFPKLDPKRYPIVNDEKLVLDLLIQEKILLVQGSAFNVKDRQHLRVVFLPRKDTLADAVGRLGRFLEQYKQ

SEQ ID NO: 916 - protein, 591 aa, Phanerochaete chrysosporium
MDQSAYSRFGRANHARRRLNLCLRPTPVYLPLLLALLAIAFVTSVDARAVSYDSRDTRDLASDEATVAVPRADNFVVGSIRGQPPTTRHFNFVVSQMNGSPDGFSKPMLVVNGLFPGPTIEANQGDRIVVHVTNTLSTRTTIHWHGLYQNGTNYYDGTAGVTECGIPPGQSLTYNFTVDDFSGTTWWHAHYDTQYTDGVTGALIVHPRKYPRGFPTWDEDIVVELTDIYHAFSATILSEYLGGGGGPLTGLQLETPDSGAINGIGQYNGSTKYTNLNLKPNKTYRLRLIHTGSAAAIRFSVDYHALTVIEADSTLTQPYTVSSVTLAVAQRYSVLLTTNQPAEPARNYWMRAALKSAVAVPGANADIRGILRYGSGHAAPTAGADPGVPGSGLADLDVAKLVPAAPRTPPPATKAYTVDFSIGGKPDGGAFATMNGTSWQPLQGTTTLLQIVDAARNGSMYAPEGSSIQPGSQFLITEDSVEVVDILLVNTGPGDHPFHLHGHTPYIMGFGTGTYTGTGLNTVNPFMRDTFAVPGSGWLLMRIVTDNPGIWTLHCHIAWHMAAGLMMQISSLPSKAAQLDIPRDIVRQCSA

SEQ ID NO: 917 - protein, 615 aa, Cryptococcus bacillisporus
MRGIVNFLFLSCSLISLVSSENTGKLPTATIDPSVFALSNDFEVSDVPTTREYTFDINKALASPDGYEREVYTVNNMFPGPVIEANTGDTIIVHVNNHLDEGQGIHWHGMRQKNTPYMDGVPGITQCPIPPGGSYTYNFTISDQSGTYWWHSHYSNAMADGLWGPLIVHSVDEPIQRGRDYDEDRIVFVTDWMHDDSEIIIAALATPAGYKGSPAPPQGDSILINGRGQTNCTATNSSSCYYPAPPEIHVPVNSRVRLRFISATAHPMYRISLDNHPLEIVETDGTAVYGPTIHEMSIAPGERYSAIINTSEGKEGDAFWLRTSVALGCMFGGVSQVGLAVVRYTGNEMTTTAEPRSYAWSDLANATARCAGLDQTYTLSPRERESCRVSRASSQSHIFNSQRGAFVNYLGNTFQGYGFNNISYQNKIFNPLLSIVQRGDPYESTLVASTTFPDMGTGVIIINNLDGPIDHPYHLHGNEFQVIGRGTGALSLDNLTNIEFSLENPVRKDTLWIQGGSWAALSIVTDNPGVWALHCHIGWHLTEGKLAVVVVQPNAVGQIACPESWANLCANTDPNAFGPARRSPSPSIQSSKTSVFQHLREVKGNVVKRRGAREA

SEQ ID NO: 918 - protein, 465 aa, Ralstonia solanacearum GMI1000
MSRLIVVSNRVAPIAEGQASAGGLAVGVYDALRDTGGVWFGWSGEIAPGASGEPSIAAKGAITFATVGLSRRDYDQYYRGFANATLWPVFHYRVDLARYERQEYHGYRRVNTQFAHQLKALVQPDDILWVHDYHLIPFAAECRALGLRNRIGFFLHIPFPSPEILTTIPPHEELMRALCAYDLLGFQTETDRVAFYDYIEREARGYIENKEHNGPVHAYGNTLRAEVYPIGVHPDEIARQAVSSLARRNPFAREADASGGRPLKLIMSVDRLDYSKGLPERFRAFEQLLDDFPDHRRHVTFVQIAPTSRQDVQSYQQIRQRLEAESGRINGKHSELDWTPIRYINKQYDRRMLMALFRASHIGYVTPLRDGMNLVAKEYVAAQDPEAPGVLVLSRFAGAARELDAALIVNPYDTRGMAEALNRALTMPLEERKARHAHMMDRLRAADLTAWRERFLADLRGASAR

SEQ ID NO: 919 - protein, 444 aa, Phanerochaete chrysosporium
MDQSAYSRFGRANHARRRLNLCLRPTPVYLPLLLALLAIAFVTSVDARAVSYDSRDTRDLASDEATVAVPRADNFVVGSIRGQPPTTRHFNFVVSQMNGSPDGFSKPMLVVNGLFPGPTIEANQGDRIVVHVTNTLSTRTTIHWHGLYQNGTNYYDGTAGVTECGIPPGQSLTYNFTVDDFSGTTWWHAHYDTQYTDGVTGALIVHPRKYPRGFPTWDEDIVVELTDIYHAFSATILSEYLGGGGGPLTGLQLETPDSGAINGIGQYNGSTKYTNLNLKPNKTYRLRLIHTGSAAAIRFSVDYHALTVIEADSTLTQPYTVSSVTLAVAQRYSVLLTTNQPAEPARNYWMRAALKSAVAVPGANADIRGILRYGSGHAAPTAGADPGVPGSGLADLDVAKLVPAAPRTPPPATKAYTVDFSIGGKPDGGAFATMNGTVRSALCS

SEQ ID NO: 920 - protein, 857 aa, Ashbya gossypii ATCC 10895
MTKDTCTGARRVINCVAQLPFRTQARGADWQVEPTAGNSALHASLTRLGDGWEQHVVGWTGEVGSADGEAPQYLTAEERAAAAGRLQERAGGLRLHPVWLLRKDQARWRAYAENVLWPALHYILNPPSDGQQENTWWYDYVRFNEAYAMKVAQVYRPGDVVWVHDYQLMLLPQLLRMRFGDALIGYFHHSPWPSNEYFRCLPKRKELLDGLLGADRVCFQNEGFARHFVSSCMRLLGAEASGETGADGTVYRISAYGGDVLVDCLPLGVDTEQLLEEAFTEDVDAKVQEIRRAYEGKHIILGRDRLDAVRGVVQKLQAFEMFLTMYPEWKDKVVLIQVSSPTGMERDHRVEVQANELVNSINAQFGDLNFNPVQHYHMRIPKNVYYSLLRAADLCVVTSVRDGMSTTALEYVTVKSRSSSLGCYASPLVLSEFSGSSTVLQDAMIVNPWDSVAVAKAIKKALSLSEEQKGKLERALWQHVPTVQDWTSKFLEGMLTLQDQKDASEHKPSTKVTPALNRPLLLQNYEKAQRRLFLFDYDGTLTPIVQDPAAAIPSARLLSILRKLALDPKNQIWIISGRDQKFLSRWLGDRLPQLGLSAEHGCFMKDVSNSEWINLASKFNMSWQIKVAEIMEKYTKKTPGSFIERKKVALTWHYRRADPELAEYSAAQLKEELEAIASGLELEVMEGKANLEVRPKFVNKGEIVKRLVWHPHGSNQTTEDEFKIDENVSKDKLPDFLLCLGDDFTDEDMFRQLIDIEDKWAEKFPNDRNEWGHYGIYPCTVGPASKKTVAKNHLTEPQQVLDTLGLLVGDVSLFQSAGTVDLDDRGHLKNSESSMKSERAGVAYAMKRSSSYKTDRN

SEQ ID NO: 921 - protein, 250 aa, Saccharomyces cerevisiae
MTTDNAKAQLTSSSGGNIIVVSNRLPVTITKKQQYGTVRVTQCRPEAGHGVGRVEEDVHFQWFGWPGLEIPDDEKDQVRKDLLEKFNAVPIFLSDEIETYTTTGSVILFYGRYSITILVRSISTRMRGSDNAKAQHQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYRADSLT

SEQ ID NO: 922 - protein, 390 aa, Archaeoglobus fulgidus DSM 4304
MRKTGGLPLSRRLARRVEELKPSGIRRFFDLVVGRDDVISLGVGEPDFPVPWRIREEMIYSLEKGYTSYTSNLGLPELREGIAEYYTRFGVKALPEQVMVTSGVSEGVDIAIRALIEPGDAALIPEPCYVSYKPLVEICGGEAVTIPTAPEFRLTYEMLMQYRDAKAKILVLNYPANPTGVSYSKKELEEIADAVNELDLIVLSDEIYAELTYTGRHVSMAALNGMEDRVVIFNGFSKAFAMTGMRVGYVIAPPDIFAGMLKIHQYCMLCAPITGQIGAIEALRSLDEVERMRAEYMRRRNFVVKRLSEIFEIKKPEGAFYAFPKISSTGMSSEEFAEKLLLEKSVAVVPGNAFGECGEGYVRLAYAVKFEKLKEAMDRIKEFVEEHGEG

SEQ ID NO: 923 - protein, 494 aa, Synechococcus sp. CC9311
MAVTKGQSPFILLYHRTPFDEGRDEKGNRIWCDQKSPNGIIPTLRNLFRTRENGTWIAWRKVDKVEDANDENIPMSNPKPFTLCRIPLEEDQISSFYHVTSKESFWPILHTFPTHFNVNNADWSIFEEVNYRFAKAACHQAAESATVWVHDYNLWLVPGYIRELRPDLKIAFFHHTPFPGNDVFAILPWREQILESLLCCDVVGFHIPRYTENFARAANCLLGAKKGSKQPVNSRFVSTGSALTEPSETPCLHYKGRKIQLLSSPVGTSPDVIQELAARADVQELADKIDDDTKKGRKLILSASRVDYTKGNEELLLAFERLLERRPDWHGKVVLMLACVAAASGMKIYEDTQRTIEETAGRINGRFSLIDWVPIRFSTRRIPYEEMVAWFTRSDICWITPLRDGLNLVAKEYAAARKDRGGALVLSEFTGASVVLDGAILTNPYSHRQMDEAIERALEMPKDEQIKRMSRMSSAVESFTVSDWVREQMDALEA

SEQ ID NO: 924 - protein, 130 aa, Saccharomyces cerevisiae
MHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 925 - protein, 822 aa, Arabidopsis thaliana
MMDYDDARGERPRLLVVANRLPVSAKRTGENSWSLEMSPGGLVSGLLGITSQFDTKWVGWPGVDVHDEIEKNALTESLAEMKCIPVFLNGVFDQYYNGYCNGILWPILHHMGLPQEDQHDTNQTFETQYDAYKKANRMFLDVIIDNYEEGDIVWCHDYHLMFLPQYLKEYNNKIKVGWFLHSPFPSSEVYKTLPSRSELLRAILAADLLGFHTYDFARHFLSTCTRILGVEGTHEGVVYQGRVTRVAVFPIGIDPDRFIRTCKLPEVTQQMNELQEKFAGKKVILGVDRLDMIKGIPQKYLAFEKFLEENPYWRDKVVLVQIAVPTRNDVPEYRKLKSQVHGLVGRINGRFGSVSSLPIHHLDCSVDFNYLCAIYAIADVMLVTSLRDGMNLVSYEFVACQEAKKGVLVLSEFAGAGQSLGVGALIVNPWDVTEVSSAIKEALNMPAEERETRHRSNFQYVCTHSAEKWGLDFMSELNGIIPESEMQMRKIPLQLPEQDVIQQYSQSNNRLIILGFFGTLAEPMNSGTKEMDLKLNPELKGTLKALCNDPKTTVVVLSRSGKNILNKNFGESNIWLAAENGMFEKQTTGEWVTNMPQNVNLDWVDGVKNVFKYFTDRTPRSYFEASETSLVWNYEYADVEFGRAQARDLLQYLWAGPISNASVDVVRGNHSVEVHAIGETKGAAIGRILGEIVHRKSMTTPIDFVFCSGYFLEKDEDIYTFFESKILSSKSPNGLDLKKENYFSAAIGQARTKARYVIDSAHGVVDLLHKLAVVADTTMTDSFSDSEIYEPRDANANENSKRWINSVRRRKVEIGDTGQIGM

SEQ ID NO: 926 - protein, 399 aa, Triticum aestivum
  misc_feature (186)..(186): Xaa can be any naturally occurring amino acid
  misc_feature (209)..(209): Xaa can be any naturally occurring amino acid
  misc_feature (313)..(313): Xaa can be any naturally occurring amino acid
DGEEGPGLRGAQRERQEGAYSDSRGIPGVRQEVAEFIQRRDGYPSDPELIYLTDGASKGVMQMLNAIIRNERDGILVPVPQYPLYSAAISLFGGSLVPYYLEEEANWGLDLVSTRQSVAEARSKGITVRAMVIINPGNPTGQCLSEANIRELLNFCYQENLVLLADEVYQQNVYQDERPFISARKXVMFDMGPPVSREVQLISFHTVSXKGYWGECGQRGGYFEMTNIPPKTVDEIYKVASIALSPNVPGQIFMGLMVNPPKPGDISYLKYSAESKSILESLRRRAQIMTDGFNSCRNVVCNFTEGAMYSFPXQIRLPQRAMDVAKSAGKAPDVYYCLKLLEATGISTVPGSGFGQKEGVFHLRTTILPRGRRTCPAIMSSFKKFNDSFMEQYQDHSRL

SEQ ID NO: 927 - protein, 175 aa, Glycine max
  misc_feature (104)..(104): Xaa can be any naturally occurring amino acid
  misc_feature (147)..(147): Xaa can be any naturally occurring amino acid
ELSFPRQVVALCQAPFLLDDPNVGLLFPADAIARAKHYLSLTSGGLGAYSDSRGLPGVRKEVAEFILKRDGYPTDPELIYLTDGASKGVMQILNTIIRGQDDGXPQYPLYSATIALLGGTLVPYYLEETANWGLDVNELRQSVEQAXKGITVKAMVIINPGNPTGQCLSEANLRE

SEQ ID NO: 928 - protein, 795 aa, Arabidopsis thaliana
MARPRLLVVSMSLPVTAKRTGEESWSFTMSPGGLVSALLGLKEFETKWIGWPGVDVHDAIGKKTLSITLAEKGCIPVFLEEVCDQYYNGYCNNILWPIFHYLGTPPEYRNDATITYQSQYEAYKKANQIFFDVVKEHYEEGDVVWCHDYHVMLLPQYLKEYNSKMKVGWFLHTPFPSSEMYKTLPSRSDLLRSVLTADLVGFHTYDFARHFLNACMCILGVEATSEGIVDQGKVTRVAVFPIGIEPERFINTSELSEVVQYMKKFKNDFGGRKLILGVDRLDTIKGIPQKYQAFEKFLEENAEWRGKVMLLQIAVPTRNGIGEYQKIKDQCHYHVGRINGRFGSISSVPIIHLDCSIDFNQLCALYAITDVLLVTSLRDGMNLVSSEFIACQKAEKGVLILSEFAGAGQSLGAGAILVNPWNIKEVSSAIGEALNMSHEEKERKHKINFQYVKTHSTQQWADDFMKLTLTNILCSKLIEITTSAELGAGLAATLELPEHDVIQQYSKSNNRLLILGFYGTLTQPMKNQERRGDGMNLELHPQLKERLKELCSDPKTTVVVLSRSEKCILDKNFGEYNMWLAAENGMFLRHTSGEWVTRIPEHMNLEWIDGVKHVFKYFTERTPGSYLETSEASLVWNYENADAEFGRAQARDMLQHLWAGPISNASVDVVRGGQSVEVHAVGVTKGSAMERILGEIVHNKSMATPIDYVLCIGCFLGKDEDVYTFFEPELTKKAKSLSSSGSDSPKKVSSTIVDLKGENYFSVAIGQTHTKARYFLDSSDDVVKLIGKLCTHNNA

SEQ ID NO: 929 - protein, 521 aa, Pleurotus ostreatus
MVLSTKLAALVASLPFVLAATKKLDFHIRNDVVSPDGFERRAITVNGIFPGTPVILQKNDKVQINTINELTDPGMRRSTSIHWHGLFQHKTSGMDGPSFVNQCPIPPNSTFLYDFDTAGQTGNYWYHSHLSTQYCDGLRGSFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVHANQTIDNYWIRAPLTGGNPAGNPNLDISLIRAILRYKGAPAVEPTTVATTGGHKLNDAEMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRTSNSDVVNLVNPPRRDVLPINGGNTTFRFFSGNSGAWFLHCHIDWHLEAGLAVVFAERPAEVNEGEQAQIVTQDWRTLCPAYDGLAPEFQ

SEQ ID NO: 930 - protein, 175 aa, Yersinia pestis CO92
MATVGIFFGSDTGNTENIAKMIQKQLGKEVAEVHDIAKSSKEDLESFDILLFGIPTWYYGEAQCDWDDFFPTLEEIDFNGKLVALFGCGDQEDYAEYFCDAMGTIRDIIEPRGAAIVGHWPTAGYHFEASKGLADDDHFIGLAIDEDRQPELTNERVEAWVKQISEELNLSEIIG

SEQ ID NO: 931 - protein, 178 aa, Bacillus subtilis subsp. subtilis str. 168
MAKILLVYATMSGNTEAMADLIEKGLQEALAEVDRFEAMDIDDAQLFTDYDHVIMGTYTWGDGDLPDEFLDLVEDMEEIDFSGKTCAVFGSGDTAYEFFCGAVDTLEAKIKERGGDIVLPSVKIENNPEGEEEEELINFGRQFAKKKRVRCLITHWELLKRLFLFFLSLYLSFDTVMR

SEQ ID NO: 932 - protein, 913 aa, Oryza sativa; identical to SEQ ID NO: 603

SEQ ID NO: 933 - protein, 463 aa, Mesorhizobium sp. BNC1
MKRLVVVSNRVADLTRTSQAGGLAVGLADSLRQRGGVWMGWDGQTLKYEEEPEPRIRKIGEVTQATIPLTEQDYAEYYLGFANSVLWPLFHYRLDLVEYKTAFLEGYRRVNAKFANALVSILRDDDLIWIHDYHLIPLAAELRERGCKQRIGFFLHIPFPPPEILAAVPRHRWLVECLLKHDVIGFQTHTDLNNLLRYVEDHLGCEILADGRIRTREREVIAGFYPIGIDVDAFVGMAEKPNDEVQIETKRREILGRRQIIGVDRLDYTKGLPDRLRAFARLLELYPEMRKSVALMQIATPTREEVEAYVDIRKELEALSGAINGRFADFNWTPVRYIHGTVPRDALAALYRASQVGFVTPLRDGMNLVAKEYVAAQSMDDPGVLVLSKFAGAAEDLHEALIVNPYDVDDMARNLCRALTMPLDERQERQRALMERIRKHDSAHWLNSFMDALEKGETKEDEE

SEQ ID NO: 934 - protein, 495 aa, Saccharomyces cerevisiae
MTTDNAKAQLTSSSGGNIIVVSNRLPVTITKNSSTGQYEYAMSSGGLVTALEGLKKTYTFKWFGWPGLEIPDDEMDQVRKDLLEKFNAVPIFLSDEIADLLYNWFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHSYDYARHFLSSVQRVLNVNTLPNGVEYQGRFVNVGAFPIGIDVDKFTDGLKKESVQKRIQQLKETFKGCKILVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 935 - protein, 565 aa, Acer pseudoplatanus
MGLMYRFLGFMFLGCLLFCKAEGAIRHYDFVVKESNFSRLCSTKSMLTVNDSFPGPEIHVHKGDTVFVNVHNQGTYGITIHWHGVKMPRNPWSDGPEYVTQCPIPAGTNFTQEINFSTEEGTLWWHAHSDWSRATVHGAIIIYPAHGTTYPYPKPYGEQTIVLASWYKADVMEVYEEAVASGAEFNTSDAFTINGQPGALFDCSTGTTFRLPVKKGETYLLRIINAILNEEMFFGIAQHNLRVVGTDGFYTKPINTEYIMITPGQTMDVLVTANQPASYYYMAASPFSDSEAAFDNATTTAILQYIGNQSAPSPIPLPTLPGTNDTTAASNFTTKFRSLASSDHPISVPKNITKHILMTVSVNLIFCPNDSCSGTPDGDRLGASLNNQSFVFPSTDILEAYTRNNFSEFTTDFPLEPPIYFNFTGDVNVTVYTGQGTKVIELEYGEVVELVYQGTNVGNAQNHPMHLHGFSFYLVGTGLGNFNNQTDPDNYNLIDPPEVNTIQLPKKGWAAIRFVADNPGVWFLHCHFERHTTWGMAVAIIVKNGGTTSTSMRPRPAYMPPCPNS

SEQ ID NO: 936 - protein, 170 aa, Synechococcus elongatus PCC 6301
MAKIGLFYGTQTGVTQTIAESIQQEFGGESIVDLNDIANADASDLNAYDYLIIGCPTWNVGELQSDWEGIYDDLDSVNFQGKKVAYFGAGDQVGYSDNFQDAMGILEEKISSLGSQTVGYWPIEGYDFNESKAVRNNQFVGLAIDEDNQPDLTKNRIKTWVSQLKSEFGL

SEQ ID NO: 937 - protein, 430 aa, Yersinia pestis KIM
MASEYIEHLAVFHAEDTLLPAKGSFFMSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 938 - protein, 684 aa, Glycine max
MSLNRGGGGEEDELYEQLWKACAGPHVEVPRTGQRVFYFPQGHMEQLEVSTNQELNQRIPLFKLASKILCRVVNVHLLAEQETDEVYAQITLVPESNQAEPMSPDPCPAELPSPRVHSFCKVLTASDTSTHGGFSVLRKHATECLPALDMSKSTPTQELVAKDLQGYEWRFKHIFRGQPRRHLLTTGWSNFVTSKRLVAGDTFVFLRGNNGELRVGVRRIAPVQSSMPSSVISSQSMHLGVLATASHAVATQTLFVVYYKPRTSQFIIGVNKYLEAMDRFSVGMRLKMRFEGDDSAETDKRFSGTIVGVEDISPHWVNSKWRSLKVQWDEPAAVPRPDRVSPWEIEPFVASASTPSVQPTMVKTKRPRPPSETPDVDTTSAASVFWDAGLQQADMAQKNVLAESKRNDSTGTWHHMQTDMNSKSNSGNAMLRNQTEGSWLSSPHSSCPSHLFQDATDDSKSVSAWPVSKPHSSRLNNDHVLDQVDKESKVETATSYRLFGIDLIDHSRNSPSVEKASAQAGNAPKVTTEGCTSTLTRTDAGHLSDVPMASSKERKQEQQQVSPKETQSKQICRSRTKVQMQGVAVGRAVDLTMLDGYDQLINELEEMFDIKGQLQHRNKWEIVFTDDEGDMMLVGDDPWPEFCNMVRRIFICSSQDVKKMSCGSKLPISSVEDGTVISSDTTET

SEQ ID NO: 939 - protein, 172 aa, Yersinia pseudotuberculosis IP 32953
MKIGLFYGSSTCYTEMVAEKIRDILGEDLVDLHNLKEVSPRLMEEYSILILGIPTWDFGELQEDWEAIWPQLTQLNLKGKIVAMYGMGDQFGYSEWFLDALGMLHDHIAPLGVKFIGFWPTDGFEFTSPKPLSANGKQFVGLALDEVNQYDLSEERIEQWCEQILLEMEALL

SEQ ID NO: 940 - protein, 615 aa, Cryptococcus bacillisporus
MRGIVNFLFLSCSLISLVSSENTGKLPTATIDPSVFALSNDFEVSDVPTTREYTFDINKALASPDGYEREVYTVNNMFPGPVIEANTGDTIIVHVNNHLDEGQGIHWHGMRQKNTPYMDGVPGITQCPIPPGGSYTYNFTISDQSGTYWWHSHYSNAMADGLWGPLIVHSVDEPIQRGRDYDEDRIVFVTDWMHDDSEIIIAALATPAGYKGSPAPPQGDSILINGRGQTNCTATNSSSCYYPAPPEIHVPVNSRVRLRFISATAHPMYRISLDNHPLEIVETDGTAVYGPTIHEMSIAPGERYSAIINTSEGKEGDAFWLRTSVALGCMFGGVSQVGLAVVRYTGNEMTTTAEPRSYAWSDLANATARCAGLDQTYTLSPRERESCRVSRASSQSHIFNSQRGAFVNYLGNTFQGYGFNNISYQNKIFNPLLSIVQRGDPYESTLVASTTFPDMGTGVIIINNLDGPIDHPYHLHGNEFQVIGRGTGALSLDNLTNIEFSLENPVRKDTLWIQGGSWAALSIVTDNPGVWALHCHIGWHLTEGKLAVVVVQPNAVGQIACPESWTNLCANTDPNAFGPARRSPSPSIQSSKTSVFQHLREVKGNVVKRRGAREA

SEQ ID NO: 941 - protein, 642 aa, Arabidopsis thaliana
  misc_feature (197)..(197): Xaa can be any naturally occurring amino acid
  misc_feature (458)..(458): Xaa can be any naturally occurring amino acid
MANRGGEYLYDELWKLCAGPLVDVPQAQERVYYFPQGHMEQLEASTQQVDLNTMKPLFVLPPKILCNVMNVSLQAEKDTDEVYAQITLIPVGTEVDEPMSPDPSPPELQRPKVHSFSKVLTASDTSTHGGFSVLRKHATECLPPLDMTQQTPTQELVAEDVHGYQWKFKHIFRGQPRRHLLTTGWSTFVTSKRLVAXGDTFVFLRGENGELRVGVRRANLQQSSMPSSVISSHSMHLGVLATARHATQTKTMFIVYYKPRTSQFIISLNKYLEAMSNKFSVGMRFKMRFEGEDSPERRYSGTVIGVKDCSPHWKDSKWRCLEVHWDEPASISRPNKVSPWEIEPFVNSENVPKSVMLKNKRPRQVSEVSALDVGITASNLWSSVLTQPHEFAQSCITSQWSSPQQCHRDANEDAKKSDWLNNSYSVSNVAKDSTLNDQMVSPVEQKKPETTANYRFIXLFGIDLMSSSLAVPEEKTAPMRPINISKPTMDSHSDPKSEISKVSEEKKQEPAEGSPKEVQSKQSSSTRSRTKVQMQGVPVGRAVDLNALKGYNELIDDIEKLFDIKGELRSRNQWEIVFTDDEGDMMLVGDDPWPEFCNMVKRIFIWSKEEVKKMTPGNQLRMLLREVETTLTTTSKTDNHSN

SEQ ID NO: 942 - protein, 174 aa, Prochlorococcus marinus subsp. pastoris str. CCMP1986
MTVGIYYATTTGKTEDVADRLHNFISSAESPKDVSDVDDLSEFEGLDGIICGIPTWNTGADEERSGTAWDSILEDIGELSLSGKKVAIFGLGDSSTYTENYCDAMEELHSYFKKAGAEMVGYVNKSSYTFDESKSVMGESFCGLPLDEDSESDLTDSRLETWASQLKGEIPSLG

SEQ ID NO: 943 - protein, 533 aa, Lentinula edodes
MLPFVSLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDAYHNFSIDGHRLTVIEVDGENHEPATVDNIQIFPGQRYSFVLTATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYKNPVRRDVTAVAIGNQTTIRFVTDNPGPWFLHCHIDLHLEFGLAVVMAEAPSLVKATDVTTPAWDELCPIYDSLTPAQLP

SEQ ID NO: 944 - protein, 174 aa, Prochlorococcus marinus str. MIT 9301
MTVGIYYATTTGKTEDVADRLHNFISSAEAPKDVSDVDDLSEFEGLDGIICGIPTWNTGADEERSGTAWDSILEDIGELSLSGKKVAIFGLGDSSTYTENYCDAMEELHSYFTKAGAEMVGYVDKSSYTFDESKSVMGDRFCGLPLDEDSESDLTDSRLETWASQLKGEIPSLA

SEQ ID NO: 945 - protein, 507 aa, Saccharomyces cerevisiae YJM789
MTMTHQQDLKGVFTAKDLDFKPAGKITKKDLNTGVTKAEYAVRGAIPTRADELKEELKKNPEVLPFDDIINANIGNPQQLDQKPLTFTRQVLAILEYPEILRVGHNELASLNLFSRDALERAERLLNDIGGSIGAYSHSQGVPGIRQTVADFITRRDGGEPATPEDIYLTTGASSAATSLLSLLCKDSQTGLLIPIPQYPLYTASASLFNAQVLPYYLDEESNWSTNSDEIEKVVQDALKKQIRPSVLIVINPGNPTGAVLSEETIARICLIAAKYGITIISDEVYQENIFNDVKFHSMKKVLRKLQHLYPGKFDNVQLASLHSISKGFMGECGQRGGYMEIIGFSQEIRDALFKLMSISICSVVTGQAVVDLMVKPPQPGDESYEQDHDERLKIFHEMRTRANLLYETFKELEGIECQKPQGAMYLFPRLVLPKKALCESERLGIEPDEFYCTSLLESTGICTVPGSGFGQRPGTYHVRTTFLAPGTKWIQDWKEFHQDFFSKYRN

SEQ ID NO: 946 - protein, 548 aa, Lentinula edodes
MFLINVVFGFWLLCVPTSLRLVSGVEIVKSHPRDKIWHEKIDHHDQLFIVNKDIAPDGFQRSTVLAGRTPQDASFPGPLITGRKGDRFTINVTDLLTDPTMDRSTSIHWHGLFQKTTNYADGVAFVSQCPIATNHSFLYDFGVPDQAGTFWYHSHLSVQYGDGLRGPIVIYDPEDPHQDLYDVDDESTIITIADWFHLTSLQLLAALVVPNADATLINGNGRYVGGPDTPLTVINVEHGKRYRFRLIDMSFDAFHGFSIDNHNLTIIEVDGINTLPHTVNFIEIYPAQRYSFVLNANRPISNYRIRALSNTGVGAHNFTNGVNSAILRYVGAPEEEPQTSQPLSSNVMIFREGDLHPLENPGAPGNPYPGGADLVLNFTLGFDAEMVLFSMNGVVFESPTVPVLLQILSGAHHAQDLLPKGGVHTLPPNKVIEINFFGGDAPAGPHPFHLHGHAFDVVRTSDSSEYNFKNPVRRDTTLVAMKNQTTIRFVTDNAGPWFLHCHIDLHLSLGLAVVLAEDTRDTKKDDMIPADWKGLCPIYNSLTPSQLP

SEQ ID NO: 947 - protein, 472 aa, Ostreococcus tauri
MGRASDNSVNPAVLAAEYAVRGPIVQKAQQLEKDLASGAKLPFDKVVYCNIGNPHALGQKPVTFFRQVLAALDCQGLDGAFPSDVVARAQEYKGSIRGGTGAYSESKGVYVLRERVAKGITARDGIKCDADDLFLLDGASAGCHHIMNVLIKSADDAIMCPIPQYPLYSAALTLYGGTLTPYYLDEEGGWTLNVEHLKEQVASARAAGKNVRALVVINPGNPTGNVLPDENLTATAQFCADEGLMLISDEVYQENVYADGKKFTSMRKIVHDAGLTDKLACLSFQSISKGYYGECGRRGGYMELTGNWDEGIKDALLKLASIALCPNLAGQVCTSMVMDPPKQGEPSYELFSKERDDILASLKRRSIKLSAALNALEGVTCNAADGAMYCFPNLTFPQKFMDDCVAAGKVPDAEYCSRLLLATGIVTVPGSGFGQKPGTWHYRITFLPSEEDIEGVAIKLADFHENFMAQYK

SEQ ID NO: 948 - protein, 521 aa, Pleurotus pulmonarius
MVLSTKLVALVASLPFVFAVTKKLDFHIRNDVVSPDGFERRAITVNGIFPGTPVILQKNDKVQIKTINELTDPGMRRSTSIHWHGLFQHKTSGMDGPSFVNQCPIPPNTTFLYDFDTAGQTGNYWYHSHLSTQYCDGLRGSFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVNANQTIDNYWIRAPLTGGNPAGNPNLDVSLIRAILRYKGAPAVEPTSVATTGGHKLNDADMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRVSNSDVVNLVNPPRRDVLPINGGNTTFRFFSGNSGAWFLHCHIDWHLEAGLAVVFAERPAEVNEGEQAQIVTQDWRTLCPAYDGLAPEFQ

SEQ ID NO: 949 - protein, 899 aa, Oryza sativa; identical to SEQ ID NO: 526

SEQ ID NO: 950 - protein, 532 aa, Pleurotus pulmonarius
MFPGARILATLTLALHLLHGALAAIGPVGDMYIVNEDVSPDGFSRSAVVARSVPITGPTPATASIPGVLVQGNKGDNFQLNVVNQLSDTTMLKTTSIHWHGFFQAGSSWADGPAFVTQCPVASGDSFLYNFNVPDQAGTFWYHSHLSTQYCDGLRGPFVVYDPTDPHLSLYDIDNADTVITLEDWYHIVAPQNAAKSHPDSTLINGKGRYAGGPTSPLAVINVESTKRYRFRLVSMSCDPNFTFSIDGHSLLVIEADAVNIVPITVDSIQIFAGQRYSFVLTADQTPDNYWIRANPNLGSTGFAGGINSAILRYVGAADADPTTTSSTSTPLLETNLVPLENPGAPGPAVPGGADININLAMAFDFTTFELTINGVPFHPPTAPVLLQILSGASSAASLLPSGSIYELAPNKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDALCPIYDALSDTDKGGIIP

SEQ ID NO: 951 - protein, 750 aa, Azotobacter vinelandii
MLLATDLDGTFLAGDPQDRLSLYQTITAHPDIQLAYVTGRSLEAVLPLLADPTLPQPDYIVADVGASLYHGETLQPIQPLQHDIDARWPGESQIAGALAGLPDLQRQDVPQARRCSYFCTPERAADPALEVIAERLGCDLLYSAGRYLDFLPRGVNKGSSLLRLVEHLGLDPEQVLVAGDTLNDLSMLTCGLKGVCVGQAEESLLEHTRHCTRVLHADSPGCGGIIQAFAHFGFLGVHGFAAETRKATEPGHAELVIVYHRLPYEEYREHGQVQRRRPSSPNGIIPTLLSFFADGRKGSWVAWAEHEEGQGLFESHTTVDAERYPRLTAARVPLCKEDIDTFYKRFSKEAFWPTLHTFWERAVFNEDDWQVFLRVNRAFAERTALEAAEGATVWLHDYNLWMVPAYLRELRPDLKLAFFHHTHFPSADVFNVVPWRRQIVGSLLQCDYIGFHIPRQVENFVDVARGVAPLKVLGRQNCAPRFVTYGCAVGLERVTTAIDTGMRQVRLGAHPVGLDLDRVRNALASPSVQNQMEQLRRELNGVRLVLAVERLDYTKGVLEKLKAFERLLADNPELQGRITLATICVPAAREMTVYDELQGQIEQAVGRINGRFARVGWTPVQFFFRSLPFEEVVAWYAMADVMWITPLRDGLNLVAKEFVATQGLLDGSGVLVLSEFAGAAAELKGALLTNPHDIADLVQNCHLALNLPKSEARARLRELFDIVAFNDIRRWGDEFLGALEEPRTDIRAIA

SEQ ID NO: 952 - protein, 468 aa, Burkholderia sp. 383
MSRLVVVSNRIADPRKAAAGGLAVAVKDSLQESGGVWFGWSGRLRGGDDQPTHGDEVQIQNVGGIQLATIDLDPQDYDAYYLGYSNNVLWPVFHYRLDLAQFDRRFADGYRRVNQLFARKLRTLLRPDDTIWVHDYQLIPLAAELRAMGCTNPIGFFLHIPMPPPPIMAAIPEHEWLMRSLFAYDLVGFQTESDLLHFEHYVEAEAGAARLPDGRLRAFGRTLSAGAFPIGINVDEFESLARDRDGIDMFERMRDEYSRRQLLVGVDRLDYTKGLPQRVHAFRQLLEQYPENRNRATLIQIAAPSREDLGAYDDLRREMDSLCGAINGDYGELEWMPMRYIHRTVARKRLPGLYRASRVALVTPLRDGMNLVAKEFLAAQDAADPGVLVLSRFAGAAEQLKSALLVNPYDTQGTAQAIQRALAMPLEERRQRHAALMAIVRKTDVHWWRTRFLDALAEAAEVAAATES

SEQ ID NO: 953 - protein, 462 aa, Arabidopsis thaliana; identical to SEQ ID NO: 37

SEQ ID NO: 954 - protein, 735 aa, Thermoproteus tenax
MGGQVRLIVVSNRLPVTISPSGEIRESVGGLATAMKSFLGAVNGGRELGLEEVVWVGWSGVPSERESNDLRERLRGMGLEPVPLSSEEVEGFYEGFSNSTLWPLFHGFSEYATYEEKHWRAYRGVNEKYAKAVVALARPGDLVWIHDYHLMLAPAIVREAAEVGVGFFLHIPFPPAELLQLLPSEWRREILEGLLGSDLVGFHTYEYSANFSRSVVRFLGYKVEMGAIAVGHRRVRVGVFPIGIDFDRFYNSSQDPSVVEEMAKLREMLGRAKVVFSIDRLDYTKGVLRRVAAWERFLREHPEWRGRAVFVLVVVPSRTGVPMYEEMKRQIDREVGRINGELGELNWVPIVYLYRFIPSPTLMALYNIADVALITPLRDGMNLVAKEFVASKRDCRGVLILSELAGASKELAEALVINPNDVGGTAEAIAEALSMSEDEQCRRIRAMQERLRMRDVVRWGTDFIYSLISAKSAREEVEKALRYMEELSVDKLKSDFAKAKRRLLLLDYDGTLVPHYPYPHMAVPDGDLLELLSRLAALPETAVYVVSGRGRDFLDGWLGRLPVGLVAEHGFFLKHPGGEWKSLGKVDPSWRQYAKGIMEDFASNVPGSFVEVKEAGIAWHYRNADETIAEKAVVELIDALSNALAGSGLSILRGKKVVEVRPAGYTKGTAAKMLLDELSPDFVFVAGDDETDEGMFEVAPQSAYTVKVGPGPTLAKFRVGDYRGLRSLLEQLRPP

SEQ ID NO: 955 - protein, 462 aa, Alkalilimnicola ehrlichei MLHE-1
MSLITISNRVALPSQLQGAQGGLAVGLRSALEDGGGLWFGWDGRHEPRLPDPRPLAVQNANGVRYATLRLTRAEYERFYLGFSNQVLWPLFHYRLPYVHCQRADREGYWAVNRLFADRLPDLPDAESPIWIHDYHFIPLGQMLRERGITNPLGFFLHTPFPAWDVYRALPDHQALLEALCAHDLVGFQTDLDRDNFLDCLRHTDAIEVIDTARARYRGRVVHIGVFPIGIDVDSVAAHARHGFYSQQGRRLQASLGDRRLIIGVDRLDYSKGLDIRFEAYRRMLERRREHRARVVYLQIAPISRGEVPEYDEIRRELEYQAGHLNCQFAEYDWAPLRYLNRGFHRANVLGFLSRAHVGLVTPMRDGMNLVAKEFVAAQDPDDPGVLVLSHLAGAARELDAAVLVNPYDPDEVAERLHQALTMPLAERRERWTRMIRCLREQDITCWRDDYLQALQTAAGASG

SEQ ID NO: 956 - protein, 404 aa, Prosthecochloris aestuarii DSM 271
MPYTHSPVFTPAQRVQNYNYAIRNIVTHARKLEAQGKKITYLNIGDPVLYGFQPPEELIEANVLALRHGHNGYSPSSGRKEAVEAIAEDACRRGISTSPDNVIITFGASEAADLVCTSMLNPGDEVLCPSPGYPLYNAIIAKLNAREVRYSLDPANDWLPDPEQVEKSITPRTKILVVINPNNPTGELYSRETLDMFVDIARRHKLLIITDEVYHKLVYEGEHIPLASLASDDVAVITIDSLSKNYMAPGWRTGWLMITNSALIPDVRQAFIKLADARLCAPMAPQYTIKAAMTMGPEYNETILSRLRAQRELTIDRLNAIEGFSCNKPSGAFYVMGKLDLDATPFKTDEEFVLKLLQEKQVLFVHGSGFGTDPASGYARIVYLPDVTILEKVYADVADFINSL

SEQ ID NO: 957 - protein, 464 aa, Novosphingobium aromaticivorans DSM 12444
MSRLIVISNRVSAGGGAQGGLAVALSAALREHGGIWFGWSGNETSEFTGHINMERVDGVTTATVDLEEQDIEEYYDGYANRTLWPLFHYRIDLAEYERSFADGYKRANERFAETALPLIEPDDLVWVQDYHMFPLGKELRARGVENRIGFFLHIPWPPRRLLATLPEARALTESLLAYDLIGFHTEEWLQSFCDYVSHELGGTIGDDGWLSVGERRVRLIACPVGIDAKEFAALAASEKAKETYERVRVSAVGRTMIVGVDRLDYSKGLEERFLGYERFLVEHPEERKEVTLLQIAPPSRGTVDSYQRIRSTLEGLAGRINGAHAGLDWVPIRYVNQGYTRDMLAGVYRASKVGLVTPLRDGMNLVAKEYVAAQDPGDPGVLILSRFAGAAEQMPEALLVNPHSAEEISDALSRAITMPGEERIRRWRTLMNGVEQHDVTWWSKHFTDALKDCHEHACGSVHRN

SEQ ID NO: 958 - protein, 926 aa, Solanum lycopersicum
MPGNKYTGNQAVASTRLERLLRERELRKSSKVSHFPNESTDNNRGNELSDHDFRQGEADNGGVSYVEQYLEGAALAYNEGWERPDGKPTRQRLLVVANRLPVSAVRRGEESWSLEISGGGLVSALLGVKEFEARWIGWAGVNVPDEAGQRALTKALAEKRCIPVFLDEEIVHQYYNGYCNNILWPLFHYLGLPQEDRLATTRSFQSQFAAYKKANQMFADVVNEHYEEGDVVWCHDYHLMFLPKCLKDYNSQMKVGWFLHTPFPSSEIHRTLPSRSELLRAVLAADLVGFHTYDYARHFVSACTRILGLEGTPEGVEDQGRLTRVAAFPIGIDSERFIRALEVTQVQEHIKELKERFAGRKVMLGVDRLDMIKGIPQKILAFEKFLEENPYWRDKVVLLQIAVPTRTDVPEYQKLTSQVHEIVGRINGRFGTLTAVPIHHLDRSLDFHALCALYAVTDVALVTSLRDGMNLVSYEFVACQELKKGVLILSEFAGAAQSLGAGAILVNPWNITEVAASIGQALNMSAEEREKRHRHNFLHVTTHTAQEWAETFVSELNDTVIEAQQRIRKVPPRLNISDAIERYSFSNNRLLILGFNSTLTESVDTPGRRGGDQIKEMELKLHPELKESLLAICNDPKTTVVVLSGSDRNVLDDNFSEYNMWLAAENGMFLRSTNGVWMTTMPEHLNMDWVDSVKHVFEYFTERTPRSHFEQRETSLVWNYKYADVEFGRLQARDMLQHLWTGPISNASVDVVQGLRSVEVRAVGVTKGAAIDRILGEIVHSKAIATPIDYVLCIGHFLGKDEDVYTFFEPELPSDCIGMPRSKVSDAPKVPGERRSVPKLPSSRTSSKSSQNRNRPVSNSDKKTSNGRRPSPENVSWNVLDLKKENYFSCAVGRTRTNARYLLSTPDDVVAFLRELAEAPISNGTS

SEQ ID NO: 959 - protein, 475 aa, Pichia angusta
MVKGNVIVVSNRIPVTIKKTEDDENGKSRYDYTMSSGGLVTALQGLKNPFRWFGWPGMSVDSEQGRQTVERDLKEKFNCYPIWLSDEIADLHYNGFSNSILWPLFHYHPGEMNFDEIAWAAYLEANKLFCQTILKEIKDGDVIWVHDYHLMLLPSLLRDQLNSKGLPNVKIGFFLHTPFPSSEIYRILPVRKEILEGVLSCDLIGFHTYDYVRHFLSSVERILKLRTSPQGVVYNDRQVTVSAYPIGIDVDKFLNGLKTDEVKSRIKQLETRFGKDCKLIIGVDRLDYIKGVPQKLHAFEIFLERHPEWIGKVVLIQVAVPSRGDVEEYQSLRAAVNELVGRINGRFGTVEFVPIHFLHKSVNFQELISVYAASDVCVVSSTRDGMNLVSYEYIACQQDRKGSLVLSEFAGAAQSLNGALVVNPWNTEELSEAIYEGLIMSEEKRRGNFQKMFKYIEKYTASYWGENFVKELTRV

SEQ ID NO: 960 - protein, 853 aa, Physcomitrella patens subsp. patens
MAEGESREYPRGPVARGSREDFVEASTAASDDNDYRMLIVGHMLPLTASRGPDEQGWTFTWDEDSLALQLKAGLPKDMEVIYIGCLKVEVDDSGQDEVAATLLENFNCVPAFLPLEVRSRFYHGFCKQMLWPLFHYMLPLSPEHGGRFNRSFWQAYVSVNKVFADKVMEVISPDDDYVWIHDYHLMVLPTFLRKRFNKVRLGFFLHSPFPSSEIYRTLPVRDEILRALLNADLIGFHTFDYARHFLSCCSRMLGLEYESKRGYIGLEYYGRTVGIKILPVGIHMEQLNAGLRLADTEWRIAELRAEFKDRTVLLGVDDMDIFKGIGLKLLALEQLLRQHPKTRNRVVLVQIANPARGRGRDIEDLQNEAYTIAQRINDEFGNDDYQPVVLLERPVALYERIAYYTIAECCVVTAVRDGMNLIPYEYIACREGSPELDAGVDRGPCPAPLKKSMLIVSEFIGCSPSLSGAIRVNPWNIEALAEAMNMSITLPDIEQQMRHEKHFRYVNTHDVAYWARSFMTDLVRTCKGHARRRCYGIGFGLGFRVVALDPDFRRLRTDLIVSAYKKSTSRAILLDYDGTMIPQASINNPMPTPEVLSILNTLCSDRKNFVVIVSGRPRQILNECFSTCKRLGLAAEHGYFYRWHQDIDWVTCRYQRDDFDEYENDRMEWKEIVEPVMQQYTESTDGSYIEEKESAMVWHHRDADPDFGSWQAKELQDHLDSVLANQPVSVKSGAHIVEVKPQGVSKGVVVEELLAMMALKSAAPDFVLCIGDDRSDEDMFESIATVTARSGLAEVFACTVGQKPSKAKYYLDDIAEVIKLLQGIAAASDPGATPASLPTATSSQVSLETSLHI

SEQ ID NO: 961 - protein, 486 aa, Oryza sativa Japonica Group; identical to SEQ ID NO: 807

SEQ ID NO: 962 - protein, 533 aa, Pleurotus ostreatus
MFPGARILATLTLALHLLHGTHAAIGPTGNMYIVNEDVSPDGFARSAVVARSVPATDPTPATVSIPGVLVQGNKGDNFQLNVVNQLSDTTMLKTTSIHWHGFFQAGSSWADGPAFVTQCPVASGDSFLYNFNVPDQAGTFWYHSHLSTQYCDGLRGPFVVYDSSDPHLSLYDIDNADTVITLEDWYHIVAPQNAAIPTPDSTLINGKGRYAGGPTSPLSVINVESNKRYRFRLVSMSCDPNFTFSIDGHSLLVIEADAVNIVPITVDSIQIFAGQRYSFVLTADQTVGNYWIRANPNLGSTGFDGGINSAILRYAGATEDDPTTTSSTSTPLLETNLVPLENPGAPGPTVPGGADININLAMAFDFTTFELTINGVPFIPPTAPVLLQILSGASSAASLLPSGSIYALEPNKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDDLCPIYDALSDNDKGGIVPS

SEQ ID NO: 963 - protein, 526 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADCTELIAAAVAPLADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVSCTYVVHPKQTTIRFVTDNPGPWFLHCHIDLHLEFGLAVVMAEAPSLVKATDVTTPAWDELCPIYDSLTPAQLP

SEQ ID NO: 964 - protein, 526 aa, Lentinula edodes
MLPFVSLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADCTELIAAAVAPPADATLINGKGRYLGGPAVPLAVINVQQGKRYRFRMISIACDAYHNFSIDGHRLTVIEVDGENHEPATVDNIQIFPGQRYSFVLTATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYKNPVSCTYVVHPKQTTIRFVTDNPGPWFLHCHIDLHLEFGLAVVMAEAPSLVKATDVTTPAWDELCPIYDSLTPAQLP

SEQ ID NO: 965 - protein, 785 aa, Xanthomonas campestris pv. campestris str. ATCC 33913
MTDQTRLPNTSSLTHPRPDPAVILATDLDGTFLAGSAEHRHQLYRLVDQHPEIRLIFITGRGLEAVMPLLTDPTIPRPDYVVCDVGATVVDGHTLQPLQPLQSMIDAHWPGEQVVAQAMRAFPQLQRQDMPQERRCSYFCDPHTLAPLRAQIEQTARALGCDVLYSADRYLDILPPDTDKGRTLGALARQLELPRERILVAGDTLNDLSMYLAGFRGVCVGDSEAALTQATAQLDATYHASAPGCGGILEAIAHFGLLADDDPHVPAVQAPRKGGAELVMVYHRLPYDEVVEHGELVRRAPRSPNGIIPSLLSFFEGGQRGSWVAWSVDDPKRGPFQTHTEVDAQRYPTLTAARVPLSKSEVDIFYKRFSKEAFWPMLHVFWERARFREDDWQVFLAVNRKFAQATSAEAAHGATVWIHDYNLWMVPAYLRELRPDLKIAFFHHTYFPSADVFNVVPWRREIIGSLMCCDYVGFHIPRQVENFVDVVRGVMPVERLAQESCAPRFLTYGCAVGLDTMTTCLRVADRDVALGAHPVGTDLRRIRAALSKPDVRNDIFKLRREIGARKLVLSVERLDYTKGTLAKLEAFERLLDSQRQLLGKVTLLMVCVPAAREMTIYRTLQTQIEQAVGRINGRFSRLDWTPVRFFAQALPFEQVVAHYAAAQVMWITPLRDGLNLVAKEFVAVQGIEGGSGVLVLSEFAGAAAELKGAVLTNPHDPADLAAGLLQALAMPDDEAAGRLRQLYDSVEYYNIDHWGRDFLDAVARSRGAHARVPLAAASTVAEPVA

SEQ ID NO: 966 - protein, 482 aa, Zea mays
MAASVTVENLNPKVLKCEYAVRGEIVIHAQRLQQQLQTQPGSLPFDEILYCNIGNPQSLGQQPVTFFREVLALCDYPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGALVPYYLNEKTGWGLEISDLKMQLENARSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSAPVREQIYKIASVNLCSNITGQILASLVMNPPKVGDESYASYKAEKDGILESLARRAKALEDAFNKLEGFSCNKAEGAMYLFPQILLPQKAIEAAKAAKKAPDAFYALRLLESTGIVVVPGSGFGQVPGTWHIRCTILPQEDKIPAVISRFRAFHEAFLAEYRD

SEQ ID NO: 967 - protein, 592 aa, Saccharomyces cerevisiae
MLSLSAKNHFTVSNSITHVIKSYHIRTLTSSAEKMPHITTPFSTSASSTKLKAFRKVRPVLQRHSSSWIVAQNHRRSLSGQSSLNDLRHLNRFPHHTLKTSNNEFYPAEQLTLEDVNENVLKAKYAVRGAIPMRAEELKAQLEKDPQSLPFDRIINANIGNPQQLQQKPLTYYRQVLSLLQYPELLNQNEQQLVDSKLFKLDAIKRAKSLMEDIGGSVGAYSSSQGVEGIRKSVAEFITKRDEGEISYPEDIFLTAGASAAVNYLLSIFCRGPETGVLIPIPQYPLYTATLALNNSQALPYYLDENSGWSTNPEEIETVVKEAIQNEIKPTVLVVINPGNPTGAVLSPESIAQIFEVAAKYGTVVIADEVYQENIFPGTKFHSMKKILRHLQREHPGKFDNVQLASLHSTSKGVSGECGQRGGYMELTGFSHEMRQVILKLASISLCPVVTGQALVDLMVRPPVEGEESFESDQAERNSIHEKLITRAMTLYETFNSLEGIECQKPQGAMYLFPKIDLPFKAVQEARHLELTPDEFYCKKLLESTGICTVPGSGFGQEPGTYHLRTTFLAPGLEWIKKWESFHKEFFDQYRD

SEQ ID NO: 968 - protein, 93 aa, Arabidopsis thaliana
  misc_feature (59)..(59): Xaa can be any naturally occurring amino acid
KKVVQVWPGKGGLKPFIPPEGLSWSLAEKGRAKKIIFSQNGGGNPSCLLGQKPLTFPRXQVVALCQAPFLLDDPNVGMLFPADAIARAKHYLS

SEQ ID NO: 969 - protein, 625 aa, Candida albicans
MRATLTSLLVSITFLVSLVAAETHTWYFKTGWVNANPDGVYERPMIGFNDTWPLPTLRVKKGDRVQLYLINGFDNLNTTLHFHGLFQNGTNQMDGPEMVTQCPIPPGETYLYNFTVDQVGTYWYHSHTAGQYGDGMRGVFVIDDDDFPYDYDEDVVLTVGDHYHKYSSDIIPSFLSRFNPTGAEPIPQNFLFNETRNLTWKVEPGKTYLVRIVNVGGFVSQYLWMEDHEFTVVEVDGIYVEKNTTDMLYITTAQRYSVLINTKNSTDKNYAFMQRVDTDMLDVIPSDLQLNGTNYIVYNEDASLPEAYDVDSLDNYLDDFYLKPLSKEKLLDDADYTITVDVQMDNLGNGVNYAFFNNITYTTPKVPTLLTVLSAGDAATNELVYGTNTNSFVLQGGDVVDIVLNNLDTGKHPFHLHGHAFQLIERHKEIPEGEDPVTYNATDHADWPEYPMVRDTVYVRPQSYIVMRFKADNPGVWFFHCHIEWHLEQGLAFQLIEDPQGIQKNEKITDNHKQICEKVGVPWEGNAAANSKDYLNLVGENVQVKRLPTGFTAKGIVALVFSCISAFLGLAAISYYDMNDIENMEKRVARDLDVYFDDDDDEEEEEEQSITEQAATGSSSSPSNK

SEQ ID NO: 970 - protein, 482 aa, Pelargonium x hortorum
MENKSKQLLSKIATNDGHGENSPYFDGWKAYDRDPFHPSQNPNGVIQMGLAENQLSSDLIEDWVRSNPEASICTLEGVGKFKDVANFQDYHGLLEFRHAVAKFMSRGRGGKVTFDPDRVVMSGGPTGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFAAPEFVSVSEILQEMDDTTCNPDLIHIVYSLSKDLGMPGFRVGIVYSFNDDVVSCARKMSSFGLVSTQTQHLLAAMLSDDVFVERFLAESRSLGRRHGVFTKGLEELGIGCLKSNAGLYFWMDLRKLLEEETFEAEMVLWKVIINEVKLNVSPGSSFHCVEPGWFRVCFANMDDETVHVALKRIRAFVRKKEVGPVKRKRFMDNLNLRLSFSSLRYDESVMLSPHIMVSPHSPLVRART

SEQ ID NO: 971 - protein, 168 aa, Bacteroides fragilis YCH46
MKKIGIFYAAKADKTSWVAEKIQKEFGTSAESVAIENAWQNDFEAYDNFIVGASTWFDGELPTYWDELLPELRTLQLKGKKVAIFGLGDQVKYPENFADGVGLLAEVFENDGATLVGFTSIDGYSFERSRALKGDKWCGLVIDIENQSEMTDKRIKDWCRQVKKEFEV

SEQ ID NO: 972 - protein, 505 aa, Bifidobacterium longum DJO10A
MNSRGLKQVDLVHAAEHRGVKMGKSHISQYVAGKTMPREDVLEFLASELDVDTNWLRGEESTTQLNSDASNSVTDGEHAATPLAMGAAKPQTDSEIPVGRRRTFGKSHKLDNVLYDVRGPVADEAMRMEANGTHILKLNIGNPAPFGFRTPDEVVYDMAHQLTDTEGYSPSKGLFSARKAIMQYAQLKNIPNVTIDDIYTGNGVSELINLSMSALLDTGDEVLVPSPDYPLWTACVNLAGGTAVHYLCDEQSEWYPDIDDIRSKITSNTKAIVIINPNNPTGALYPKEVLQQIVDIAREHQLIIFSDEIYDRLVMDGLQHISIASMAPDLFCVTFSGLSKSHMIAGYRIGWMILSGNKRIAKDYIEGLNMLANMRMCSNVPAQSVVQTALGGHQSVNDYIVPGGRVHDQRDLVYDMLNQIPGITAVKPKAAFYIFPKIDVKRFNIHSDEQFALDLLHDKHILISHGGAFNWHRPDHFRVVYLPRMGMLRETMGEISDFFSYYWQS

SEQ ID NO: 973 - protein, 400 aa, Fusobacterium nucleatum subsp. vincentii ATCC 49256
MEEKMKISDRVKNMKYSAVRKLAPLAAEAEKKGIKVYRLNIGQPNIETPKLFFEGLKNIPDQVIKYADSRGISVLLEQVIEVYARDGHILKKEDIIVTEGGSEALTFAMLAICNPDDEVLIPEPFYSNYKSFLDISGAKIIPIPTDIKNNFALPKKEEIQKLITSKTKAILYSNPCNPTGKVYTEVEVKLLADLAIENDLFIIADEPYREFIYDDKDKHHSLLDIEKAKENVIIIDSVSKHYSACGARVGFLISKNKDFMTYIMKLCQARLAAPTVEQYAVANLMKAPKEYFKEIKEIYRRRRDIIVDSLNKIEGVTCSTPKGAIYAFAKLPVESSEDFCKWLLTEFVYDNSTVMLAPGEGFYETEGLGKNEVRFSFCVGEDDIEKAMKVLEEALKVYKK

SEQ ID NO: 974 - protein, 521 aa, Pycnoporus cinnabarinus
MISMGFRLFSLFVAIAAISGTLAAIGPKADLVISDAVVNPDGTPRAAVVVNGAFPGPLISGKKGDHFQLNVINKLTNHTMLKTTSIHWHGLFQEHTNWADGPAFVNQCPIASGHSFLYDFHVPDQAGTYWYHSHLSTQYCDGLRGPLVVYDPHDPQAHLYDVDNDDTVITLADWYHVAAKLGPQFPRGANSTLINGLGRAATDSTSDLTVIAVEHGKRYRFRLVSISCDPNHTFSIDGHNMTIIEVEGVNSKPLTVDSIQIFAAQRYSFVLNANQPVDNYWIRANPSGGTVGFEGGINSAILRYKGAPDAEPTNPTAPTSVIPLVETNLHPLKPMQVPGRSGIGNVDYAKTLNFNFNGTNFFINNATFTPPTVPVLLQILSGAHNAQDLLPAGSVYTLPPHSAIEITMPATTLAPGSPHPFHLHGHVFAVVRSAGSTEYNYHGPIFRDVVSTGLPGDSVTIRFMTDNPGPWFLHCHIDFHLEAGFAIVFAEDVNGIKYANPVPPSWAELCPIYDKLPESDH

SEQ ID NO: 975 - protein, 727 aa, uncultured archaeon GZfos12E2
MRRLLIISNRLPVSVERRKNELRFSSSVGGLATGLNALHQRYESVWVGWPGIAINREETDYVESKLSEFNCYPVFLSQGEVEKYYYGFSNKTLWPLFHYFPQYAKYEHSEWSAYEHVNRKFCERVAEIAKPEDIIWIHDYHLMLLPGLIRERFPDATIGFFLHIPFPSADLFRLIPWRRRILEGVLGADLIGFHTYDYAHNFLCSVLRLLGYEHEFGKLAIGDRIVQVDVHPMGVEVQKFVRATSGRGIKREVARLRSRFKNCKIIFSMDRLDYTKGIPERLYAFEHFLETHPEWHEKVVFILKIAPSRTKVGQYRVLKQEIDELVGRINGKYGTPEWVPISYFYRSLPFQTIVAFYLAADVALLTSMRDGMNLIAKEFVASRVDGKGVLILSEMAGAARELGEALVVNPNNKEEVAEALNEALRMPEEEQKSRNEEMQKRLSHYDVFHWGSGFIRSVLETKRLQEELNMKKLSEKIREELKNAYKAADKCLLLLDYDGTLVPFADKPERAKPDKELLYLFRALSEPPENTVVIISGRDKETLERWFGDTGVCLVAEHGVRLKEEEGEWKEIELLKEDWKEKIIPILDLFVDRAPGSFIEEKSFSLVWHYRKVDPELGELRAKELTDQLIDLTACTELQVMKGNKVVEVKDGRVNKGIAASHWLTKGFGFILAVGDDLTDEDMFKVLPEGAYSVKIGFTPSKARFYLGSPKEVRALLDEMELVEVYK

SEQ ID NO: 976 - protein, 404 aa, Streptococcus pyogenes MGAS8232
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYLKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 977 - protein, 175 aa, Edwardsiella tarda
MAIVGIFFGSDTGNTENIAKMIQKQLGKDVAEVHDIAKSSKEDLEAFDILLLGIPTWYYGEAQCDWDDFFPSLEEIDFSGKLVALFGCGDQEDYAEYFCDAMGTIRELVEARGATIVGHWPTAGYHFEASKALVDSNTFVGLAIDEDRQPELTAERVDAWVKQLSAEMHLADILG

SEQ ID NO: 978 - protein, 601 aa, Arabidopsis thaliana
MANVEADFRTSGSNDDELYTELWKACAGPLVEVPRYGERVFYFPQGHMEQLVASTNQGVVDQEIPVFNLPPKILCRVLSVTLKAEHETDEVYAQITLQPEEDQSEPTSLDPPLVEPAKPAVDSFVKILTASDTSTHGGFSVLRKHATECLPSLDMTQPTPTQELVARDLHGYEWRFKHIFRGQPRRHLLTTGWSTFVTSKRLVAGDAFVFLRGETGDLRVGVRRLAKQQSTMPASVISSQSMRLGVLATASHAVTTTTIFVVFYKPRISQFIISVNKYMMAMKNGFSLGMRYRMRFEGEESPERIFTGTIIGSGDLSSQWPASKWRSLQIQWDEPSSIQRPNKVSPWEIEPFSPSALTPTPTQQQSKSKRSRPISEITGSPVASSFLSSFSQSHESNPSVKLLFQDPATERNSNKSVFSSGLQCKITEAPVTSSCRLFGFDLTSKPASATIPHDKQLISVDSNISDSTTKCHDPNSSNSPKEQKQQTSTRSRIKVQMQGTAVGRAVDLTLLRSYDELIKELEKMFEIEGELSPKDKWAIVFTDDEGDRMLVGDDPWNEFCKMAKKLFIYPSDEVKKMRSKSLLGDKGTIVNLESDQRTVHV

SEQ ID NO: 979 - protein, 177 aa, Vibrio harveyi
MARVGIFFGSDTGNTEAVAKMIQKQLGKRLVHVQDIAKSSKEDIDNFDLLLLGIPTWYYGEAQCDWDDFFPELEQIDFSTKLVAIFGCGDQEDYAEYFCDAMGTVRDIVEAKGGTILGHTSTEGYEFEASKALVEGDDSQFVGLCIDEDRQPELTDERVENWVKQIYEEMCLAELEG

SEQ ID NO: 980 - protein, 133 aa, Gibberella zeae PH-1
MVNPPKQGQPSYELYKKEYDGIFTGLQERATALHKAFSQMEGVECAEPQGSMYLFPTINLPAKAAEAAKAEGRSADEFYCMRLLEATGICVVPGSGFGQKENTLHFRTTFLAPGTEWVGRIVKFHNEFLDKYR

SEQ ID NO: 981 - protein, 489 aa, Nicotiana glutinosa
MGFENEKNNSILSKLATNEEHGENSPYFDGWKAYDNDPFHPLKNPNGVIQMGLAENQLCFDLIEEWIKRNPNASICTTEGIKSFRAIANFQDYHGLTEFRRAIAKFMEKTRGGRVTFDPERVVMAGGATGANETIIFCLADAGDAFLVPSPYYPAFNRDLRWRTGVQLIPIPCDSSNNFQITTKAVKEVYENAQKSNIKVKGLILTNPSNPLGTTLDRDTLKNLLTFTNQHNIHLVCDEIYAATVFSTPQFVSIAEIVNDEMRHCNKDLVHIVYSLSKDMGLPGFRIGIVYSFNDTVVSCARKMSSFGLVSTQTQYLLAEMLSDEKFVSNFLTESSKRLAKRHKHFTNGLEQVGIKCLRSNAGLFCWMDLRPLLKESNFDAEMSLWRVIINDVKLNVSKGSSFDCQEPGFFRVFFANMDDETVDIALRRIRRFVSVKRTGDETTAMERKQQWKKNNLRLSFSKRMYDESVNLSPLSSPIPHSPLVRART

SEQ ID NO: 982 - protein, 531 aa, Pleurotus eryngii
MFPGARILATLTLALHLLHGTHAAIGPIADMYIVNEDVSPDGFARSAVVARSVPATDPTPASVSVPGVLVQGNKGDNFQLNVRNQLSDSTMLKTTSIHWHGFFQSGSTWADGPAFVNQCPIASGNSFLYDFNVPDQAGTFWYHSHLSTQYCDGLRGPFVVYDPSDPHLSLYDVDNADTVITLEDWYHVAAPQGAVLPTPDSTLINGKGRFAGGPTSPLAIINVESNKRYRFRLISMSCDPNFTFSIDGHSLQVIEADAVNIVPIVVDSIQIFAGQRYSFVLNANQAVDNYWIRANPNLGSTGFEGGINSAILRYAGATENDPATTSSTSTPLLETNLVPLENPGAPGPAVPGGADININLAMGFDFTNFEMTINGSPFKAPTAPVLLQILSGATPAASLLPSGSIYALAANKVVEISIPALAVGGPHPFHLHGHTFDVIRSAGSTTYNFDTPARRDVVNTGIDANDNVTIRFVTDNPGPWFLHCHIDWHLEIGLAVVFAEDVASIKAPPAAWDDLCPIYDALSDSDRGGIA

SEQ ID NO: 983 - protein, 171 aa, Trichodesmium erythraeum IMS101
MSKIGLFVGTTTGKTEEAAEKIKEEFGGDDVVTIHDISEASPEDFDGYQNVIIGCPTWDVGELQSDWSGFYSEELDNVKFTGKKVAYFGTGDQIGYADNFQDAMGILEEKITGLGGTTIGSWSTEGYDHEDSKAVKNGKFVGLALDDDNQADLTDERIKEWVKQLKTEFGV

SEQ ID NO: 984 - protein, 434 aa, Geobacter metallireducens GS-15
MRNELVTPGAGELTYEIRNIVNVAEKLQKHGVKINWENIGDPIVKGEEIPRWMKEIVANEVMENDTWGYCHTRGVLETREFICGLTNNRGGARITPDDIIFFNGLGDAISTVYGNLRHESRILMPSPTYTTHSIGEAAHAQASPVCYRLDPANNWFPDLEDMENHVRYNPQISGILLINPDNPTGMVFSRETLEKIVAIARKYELFIIADEVYNNITYNGQTTVPISDVIGDVPAIAMKGISKEIPWPGSRCGWIEVYNGAKDDQFRKYINSILSAKMNEVCSTTLPQKCIPAIMKHPEYQTYLQERIRRYEKMSTITFDCLREVPELMVNRTNGAFYMSVAFRDGLLTNGQSLPIENAEVRELVEGLVNAPGVSPDKRFVYYLLASTGICIVPLSSFNTPLQGFRVTLLEKDEAECLRIYQTLAKKIAEYLKS

SEQ ID NO: 985 - protein, 498 aa, Mycobacterium leprae TN
MTSRGNHGSKTSSDKHLGDSDFVVVANRLPVDQVRLPDGTAIWKRSPGGLVTALEPLLRQRRGAWVGWPGVINDNVDLDLTIKSIVQDGLTLYPVRLNTHDVAEYYEGFSNATLWPLYHDVIVKPIYHCEWWERYVDVNRRFAETTSRTAAYGGTVWVQDYQLQLVPKMLRIMRPDLTIGFFLHIPFPPVELFMQIPWRTEIIEGLLGADLVGFHLTSGAQNFLFLSRHLLGANTSRGLVGVRSRFGEVQLKSHTVQVGAFPISIDSKEIDQATRDRNVRRRAREIRAELGNPRKILLGVDRLDYTKGIDVRLRAFAELLAEGRAKRDDTVLVQLATPSRERVESYKILRNDIERQVGHINGEYGEVGHPVVHYLHRPIPRDELIAFYVASDVMLVTPLRDGMNLVAKEYVACRNDLGGALVLSEFTGAAAELRQAYLVNPHDLEGVKDTIEAALNQLAEEARRRMRSLRRQVLAHDVDRWARSFLDALAEAPARDAT

SEQ ID NO: 986 - protein, 435 aa, Pelargonium x hortorum
MGLAENQLSSDLIEDWVRSNPEASICTLEGVGKFKDVANFQDYHGLLEFRHAVAKFMSRGRGGKVTFDPDRVVMSGGPTGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFAAPEFVSVSEILQEMDDTTCNPDLIHIVYSLSKDLGMPGFRVGIVYSFNDDVVSCARKMSSFGLVSTQTQHLLAAMLSDDVFVERFLAESRSLGRRHGVFTKGLEELGIGCLKSNAGLYFWMDLRKLLEEETFEAEMVLWKVIINEVKLNVSPGSSFHCVEPGWFRVCFANMDDETVHVALKRIRAFVRKKEVGPVKRKRFMDNLNLRLSFSSLRYDESVMLSPHIMVSPHSPLVRART

SEQ ID NO: 987 - protein, 455 aa, Xanthomonas campestris pv. vesicatoria str. 85-10
MSRLVVVSNRVAVPGETRAGGLAVGLLAALKERGGMWFGWSGKTVRGDSGGMHEQTEGDITFVTMDLNKRDIDSYYNGFANRTLWPLLHFRLDLVDYDRATREGYMRVNRLFAEKLAPLLKDSDTLWIHDYHMIPLGAMLRELGVGCKMGFFLHVPMPSADLVQAMPDHARLFSTFYAYDLVGFQTQRDAERFKAYVRLFGGGRILEGDLVEGPGGRRFTASSFPIGIDTDLIAHQAKASAGKQAVRDLRESLRGRQLAIGVDRLDYSKGLPERFQGFERYLERYPDQSGSLTYLQIAPVSRGDVTEYRQLRSQLEQIAGHINGGHAEPDWTPLRYVNQNFSHATLTGFYRAASVCLVTPLRDGMNLVAKEFVAAQDPADPGVLVLSLFAGAADEMKEALLVNPHDLDGVADAIATAASMPLASRIERWHAMMDHLRKNNINHWRQRYLQALSEV

SEQ ID NO: 988 - protein, 479 aa, Schizosaccharomyces pombe
MSDAHDTIKSLTGDASNSRRLIVVSNRLPITIKRKDNGTYDFSMSSGGLVSALSGLKKLMTFQWLGWCGQEIPEDEKPMIIQRLQDECSAIPVFLDDETADRHYNGFSNSILWPLFHYHPGEINFDEENWEAYRAANYAFAEAIVKNLQDGDLIWVQDYHLMVLPQMLRELIGDKFKDIKIGFFLHTPFPSSEIYRVLPVRNEILEGVLNCDLVGFHTYDYARHFLSACSRILNLSTLPNGVEYNGQMVSVGTFPIGIDPEKFSDALKSDVVKDRIRSIERRLQGVKVIVGVDRLDYIKGVPQKFHAFEVFLEQYPEWVGKVVLVQVAVPSRQDVEEYQNLRAVVNELVGRINGRFGTVEYTPIHFLHKSVRFEELVALYNVSDVCLITSTRDGMNLVSYEYICTQQERHGALILSEFAGAAQSLNGSIVINPWNTEELANSIHDALTMPEKQREANENKLFRYVNKYTSQFWGPKLCR

SEQ ID NO: 989 - protein, 434 aa, Leptospira interrogans serovar Copenhageni str. Fiocruz L1-130
MRRNIVHSGADALIYEIRQIVAVAKKLEALGLQITYENIGDPILKGESIPDWMKEIVSNLILKDKSWAYTATQGYEPTRKFLAEKVNERGGAQISADDLLFFNGLGDAVAKIFGFMRREARVLGPSPAYSTISSAEAAHSGYEHLTYNLLPEHNWMPDLEDMENKVKYNDSIAGILLINPDNPTGAVYDKNLMKKIVAICEKYDLMLICDETYAHVNYSDHGPLHLSEVIGDKVPGMALRSISKEFPWPGGRCGWLEIFNKEKDPVFSRYVKSLLDAKMLEVCSTTLPQMAIPEVYSHPDFIPHLKRRNEKFKKRAHVATEYFAELRGVKVVEPKGAFYLTVAFDDDVLNSSMKLEIENKKADEFIQPLLASAANDRRFVYYLLASTGICVVPLSAFCTLKDGFRVTLLEEDEEKFNWIYKTLRDKIGEYIASA

SEQ ID NO: 990 - protein, 327 aa, Triticum aestivum
  misc_feature (264)..(264): Xaa can be any naturally occurring amino acid
  misc_feature (266)..(266): Xaa can be any naturally occurring amino acid
  misc_feature (274)..(274): Xaa can be any naturally occurring amino acid
MRRFLTDRARRAVAASLRGATRPAAPSPAPAPAPAAALSRPSPSAPSAMAAYMARAMSTSAAGTPPVSLDTINPKVLEFKYAVRGEIVTHAQNLEQELHKNPESLPFDEILYCNIGNPHSLGQQPVTFFREVLSLCDHPALLDKSETHALYSSDAIERAWQILEKIPGRATGAYSHSQGVKGLRDEIAAGIAARDGFHASGDNIFLTDGASPAVHMMMQLLIRSEKDGILCPLSQYPLYSASIALHGGSFVLYFLDEETGWGLXVXELKKQVNXGRSKGFMSERPGHNPGNPSGRVLARETKENVNFEKTRVGFLGNRLPKNLCEDT

SEQ ID NO: 991 - protein, 485 aa, Zygosaccharomyces rouxii
MTVSKKDSGKTSPGNIVVVSNRLPVTISKNAMGKYEYKFSSGGLVTALQGLKKTSTFQWYGWPSLEIPDDEKPVVKKDLLEKFNAIPIFLSDEIADLHYNGFSNSILWPLFHYHPGEINFDENAWLAYNEANATFASEICGNLQDNDLVWVHDYHLMLLPEMLSAHIQRKGLKNIKLGWFLHTPFPSSEIYRILPVRQEILNGVLSCDLIGFHTYDYARHFLSSIQRCLNVNTLPNGVEYQGRFVNVGAFPIGIDVDTFKEGLQKENVKQRIRTLQERFKGCKIMVGVDRLDYIKGVPQKLHAMEVFLNEHPEWIGKVVLVQLAIPSRGDVEEYQYLRSVVNELVGRINGQFGTIEFVPIHFMHKSIPFEELISLYAVSDACIVSSTRDGMNLVSYEYIACRKKGSLILSEFTGAAQSLNGALIVNPWNTDELSDSINEALTLPDEKKDSNWEKLYKYISKYTSAYWGENFVHELNATGTIKTGQ

SEQ ID NO: 992 - protein, 171 aa, Synechococcus sp. CC9605
MRFTIVYASATGHTEDIAERLKVLLPGSELKDLDRIDFTKELEESEALICCTPTWNTGSETKRSGTTWDQHIDNIPHLSLKGKPIAIVGLGDSAAFSKYFCDAMEELYKLFESAGGRMIGHVSVEQYIFDNSKSVVDGMFCGLPLDEDNESEKTDERLQSWARLIMQEAII

SEQ ID NO: 993 - protein, 577 aa, Brassica rapa subsp. chinensis
MGVWWIVVVALLAHTASAAVREYHWEVEYKFGLPDCKEGMVMAVNGQFPGPTIHALAGDTIVVHLTNKLATEGLVIHWHGIRQLGSPWADGAAGVTQCAITPGETFTYKFTVDKPGTHFYHGHYGMQRSAGLYGSLIIDAAKGKIEPLRYDGEFNLLLSDWWHESVLSQELGLSAKPMRWIGEAQSILINGRGQFNCSLAAQFSNATAQFSNTSLPMCKFKKGDQCAPQRLHVEPNKTYRIRLASTTGLASLNFAVQGHKLVVVEADGNYITPFATSDVDIYSGESYSVLLTTDQDPSQNYWISVGVRGRKPKTPPALTVLHYVTAPSSQPPSSPPPETPRWNNFDRSRNFSKRIFSAMGSPPPPRKFKKRLILLNTQNMIDGATKWALNNVSLVVPATPYLGSVKYKLRRGFDRKSPPTTFPMDYDVMNPPRNRNTTKGNGIYVFPFNVTVDVILQNANGLDANASEIHPWHLHGHDFWVLGYGEGKFRPEIDEKTYNLKNPPLRNTVALYPYGWTALRFVTDNPGVWFFHCHIEPHLHMGMGVVFAEGLNRIGKVPDEALGCGLTKQFLMNRNNP

SEQ ID NO: 994 - protein, 352 aa, Oryza sativa
  misc_feature (249)..(249): Xaa can be any naturally occurring amino acid
  misc_feature (285)..(285): Xaa can be any naturally occurring amino acid
PQQPPTPLNFLIRRRRQDVRRRRRRREEAAGLRGAEREREEGAVRGAGGAVPARLRAPELIYLTDGASKGVMQMLNTIIRNERDGILVPVPQYPLYSAAISLFGGSLVPYYLEEEANWGLDFVNLRQTVASARSKGITVRAMVIINPGNPTGQCLSEGNIKELLKFCFHENLVLLADEVYQQNIYQDERPFISARKVLFDMGPPMSREVQLVSFHTVSKGYWGECGQRGGYFEMTNLPPKTVDEIYKVXSIALSPKVPGQIFMGLMVNPPKPGDISYLKFSAESXADVFYCLKLLEATGISTVPGSGFGQKEGVFHLRTTILPAEEDMPAIMTSFKKFNDTFMDQYDGYSRM

SEQ ID NO: 995 - protein, 124 aa, Brassica napus
MAPSVAVENLNPKVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDA

SEQ ID NO: 996 - protein, 389 aa, Fulvimarina pelagi HTCC2506
MRKHGSGPSDRSGIEPFHAMTFLAEANRLKAEGADVLSLAVGQPASPAPLPAREAATTMIGRGAVGYTDAMGRPALRSALAAHYRQAYGVTIDPARVMITSGASGGFNIAFLAAFEAGDRIAIAAPGYPAYRNIMRALGIAPVEIEVGPSDDYILTSDRLEAYFRREPFQGVLIASPANPTGTMTPPDEIRRIADFCRTNGVWLISDEIYHRLSFGQEERSALQDLEEAIVVNSFSKYYCMTGWRIGWMILPPSLTDAAERLGQNLYISASDLSQTAALAALSAGDELDAVRESYRRNRLTMRERLPEIGFRTIAPIDGAFYAYAQIPEGFPSATVFAKTLLKQSHVAVTPGTDFDLRRGDGFVRLSYAGAEADVARALDRIADFVSKA

SEQ ID NO: 997 - protein, 595 aa, Gibberella zeae PH-1
MLFRFLALLPFVAGAFAEYKVHDDTFKPDYVLEATLDDIKINCVSRSSIVFNGTSPGPTIYLQEEQTTWIRVYNKIPDNNVTVRAAPFSDGTPLVSQWPIPAGQFFDYEIRPEIGDAGSYFYHSHVGFQIVTAFGALIVRDARKPEYKYDGDIPLLVGDNYAAEDEVIEQGLLADPFKWSGEPQAITIQGNSGNKSFYEAPDSSCMPHVVHVDPGKTYRLRFISATALSMIKLGIEDHENLTVIEADGSYTKPAKIDHVQVSPGQRYSYLMKTKTSKEVCGGDKSQYWIRYESRDRPKVISGYALLKYRCDKNQKLPKSLPETSPIELSNSTADYLEYALEGLSEKNNQAFPKLSEVTRTVVIQINQILTTGAYVNGTLNGTVAWAQNGLPWKENVQAERRQVPYLIQIYENGTTPNYTLALEHHGFDPETKAFPAKVGEVLDIVWENNNGPTGGWDYHPMHVHGYHVYDLGSGNGTYNATENEAHFENFTPVLRDTTNLYRYAVKGVPHHTAGWRAWRIRITEENIGAWMMHCHIAQHQVMGMATVWVFGDAEQIRGKFPAPPYTQGYLTYGGSAYGTEDDQPWVNEYYSDKNN

SEQ ID NO: 998 - protein, 478 aa, Brassica napus
MALEYDLLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGEGDGILVPVPQYPLYSATISLLGGSLVPYYLDESENWGLDVNNLRQSVAQARSQGISVRAMVIINPGNPTGQCLSEANLKEILKFCYNEKLVLLGDEVYQQNIYQDERPFISSKKVLMDMGSPFSKGVQLVSFHTVSKGYWGECGQRGGYFEMTNIPPRVVEEIYKVASIALSPNVSAQIFMGLMVSPPKPGDISYDQFARESKGILESLRRRAKIMTDGFNSCKNVVCNFTEGAMYSFPQIRLPPGALQAAKQAGKVPDVFYCLKLLEATGISTVPGSGFGQKEGVFHLRTTILPAEEEMPEIMDSFKKFNDEFMTQYENSFGYSRM

SEQ ID NO: 999 - protein, 172 aa, Vibrio fischeri ES114
MKIGLFYGSSTCYTEMASEKIRAFIGEDLVDVFNIKETPVTTMNDYDLLLLGISTWDFGEIQEDWLAVWEELDGLSLDGKTIALFGLGDQEGYGEWFLDAMGLLHDELKATNAKFIGYWKNEGYQFDASKALTEDESHFVGLALDEDSQYDKSNERIEQWCEQILVEYHESL

SEQ ID NO: 1000 - protein, 434 aa, Cytophaga hutchinsonii ATCC 33406
MRNKILSDGAKELSYEIREIVKKADLINKNGQSIVFENIGDPIQKNNVVPQWIRETISNLTLDNKSYSYSPSKGILKTRQFLAELNNKKAGAQITADDILFFNGLGDAIAKVYQFISRSSRVIGPSPAYSTHSSAEAAHASQDPITYKLDPNNHWYPDLDDLYNKVKYNPNIIGILIINPDNPTGMVYPLETLKRIVEIAREFNLFLLSDEIYLNITYNGARAYSLAEVIEDVPGIAMKGISKEFPWPGSRCGWMEYYNRGKDQDFDKFCSALDNAKMIEVCSTTLPQLAIPVIMSDPRYLPYREELNSKIGKRSKIIAGILGQIPELMFNETYGAFYNTIVFKDGVLNDKQTLPIENAANKALVEKWISEPNVDLDKRFVYYLLAAKGICVVPISSFCSDLKGFRVTLLEENEELLEQTFTSIRDAIRLYLKS

SEQ ID NO: 1001 - protein, 486 aa, Glycine max
MASDSPFPVTAQNINPKVLKCEYAVRGEVVTLAQNLQKDLQANPGSHPFDEILYCNIGNPQSLGQQPITFFREVLALCDHPAILDKSETQGLFSTDAIQRAWQIVDQIPGRATGAYSHSQGVKGLRDTIAAGIEERDGFPANPDDIFMTDGASPAVHNMMQLLIRSENDGILCPIPQYPLYSASIALHGGCLVPYYLDEATGWGLEIPELKKQLEAAKSKGINVRALVVINPGNPTGQVLGEANQRDIVEFCKQEGLVLLADEVYQENVYVPEKKFHSFKKVSRSMGYGENDITLVSFQSVSKGYHGECGKRGGYMEVTGFSAEVREQIYKVASVNLCSNISGQILASLVMSPPKVGDESYDSFMAEKENILASLARRAKTLEDAFNKLEGVTCNKAEGAMYLFPQIRLSEKAIKAAEAANATPDNFYCKRLLNATGVVVVPGSGFGQVPGTWHFRCTILPPEEKIPAIVTRLTEFHEKFMDEFRD

SEQ ID NO: 1002 - protein, 93 aa, Arabidopsis thaliana
  misc_feature (25)..(25): Xaa can be any naturally occurring amino acid
  misc_feature (66)..(66): Xaa can be any naturally occurring amino acid
  misc_feature (84)..(84): Xaa can be any naturally occurring amino acid
MGSKGLKQDTRMEKVRRGRYGGRGXLYFRSFWSWQKEGKKIIFKKVGNLHALGQKHWTFPRQVVGXCKLVLLDDPNVGMLFQLXCYARAKNYL

SEQ ID NO: 1003 - protein, 423 aa, Saccharophagus degradans 2-40
MTLPKDPESSTVKPVKKDKRKNIIKSEKLLGVCYDIRGPVLEHANRLEEEGHRILKLNIGNPAPFGFEAPDEIITDVVYNIREAQGYTASRGLFPARKAIMHECQRQEIPNVEIEDIFLGNGVSELIVMANQALLNNGDEVLVPSPDYPLWTAAVNLAGGKAVHYMCDEQSDWFPDIDDMRSKITSRTRAIVVINPNNPTGAVYSQELLEQIVALAREHQLVIFADEIYSKILYDDAEFVPMGRIAKDVLCVTFNGLSKSYRLAGFRSGWIILSGAKHLAKDYIRGIDMLASMRLCANVPAMLAVQTALGGYQSINELILPGGRLLEQRDAAIEELAKIPGVSCVVPKGAIYLFPKIDRTMYDFDDDQQLILDFLIQEKILLVQGTAFNWKQPDHFRIVFLPQADQLRQAIIKFGEFLQQYRI

SEQ ID NO: 1004 - protein, 481 aa, Glycine max
MPPKPLDYGSINENVKKSQYAVRGELYLRASELQKEGKKIIFTNVGNPHALGQKPLSFPRQVVALCQAPFLLDDPNVGLLFPADAIARAKHYLSLTSGGLGAYSDSRGLPGVRKEVAEFILRRDGYPTDPELIYLTDGASKGVMQILNTIIRGQDDGILVPVPQYPLYSATIALLGGTLVPYYLEETANWGLDVNELRQSVEQARFKGITVKAMVIINPGNPTGQCLSEANLREVLQFCYQENLALLGDEVYQTNIYQDERPFISSRKVLMDLGPPISKEVQLISFHSVSKGYYGECGQRGGYFEMTNIPPETVDEIYKVASISLSPNVPAQIFMGVMLHPPQPGDISYDKFVRESTGILESLRRRARLMTDGFNSCRNVVCNFTEGAMYSFPQIRLPPRALEAAKQAGKVPDVYYCLKLLEATGISTVPGSGFGQKEGVFHLRTTILPAEEDMPDIMDSFKKFNDEFMEQYEDDRGYSRL

SEQ ID NO: 1005 - protein, 518 aa, Pycnoporus cinnabarinus
MSRFQSLFFFVLVSLTAVANAAIGPVADLTLTNAQVSPDGFAREAVVVNGITPAPLITGNKGDRFQLNVIDQLTNHTMLKTSSIHWHGFFQQGTNWADGPAFVNQCPIASGHSFLYDFQVPDQAGTFWYHSHLSTQYCDGLRGPFVVYDPNDPHASLYDIDNDDTVITLADWYHVAAKLGPRFPFGSDSTLINGLGRTTGIAPSDLAVIKVTQGKRYRFRLVSLSCDPNHTFSIDNHTMTIIEADSINTQPLEVDSIQIFAAQRYSFVLDASQPVDNYWIRANPAFGNTGFAGGINSAILRYDGAPEIEPTSVQTTPTKPLNEVDLHPLSPMPVPGSPEPGGVDKPLNLVFNFNGTNFFINDHTFVPPSVPVLLQILSGAQAAQDLVPEGSVFVLPSNSSIEISFPATANAPGFPHPFHLHGHAFAVVRSAGSSVYNYDNPIFRDVVSTGQPGDNVTIRFETNNPGPWFLHCHIDFHLDAGFAVVMAEDTPDTKAANPVPQAWSDLCPIYDALDPSDL

SEQ ID NO: 1006 - protein, 480 aa, Glycine max
MPPKPLDYGSINENVKKSQYAVRGELYLRASELQKEGKKIIFTNVGNPHALGQKPLSFPRQVVALCQAPFLLDDPNVGLLFPADAIARAKHYLSLTSGGLGAYSDSRGLPGVRKEVAEFILRRDGYPTDPELIYLTDGASKGVMQILNTIIRGQDDGILPVPQYPLYSATIALLGGTLVPYYLEETANWGLDVNELRQSVEQARFKGITVKAMVIINPGNPTGQCLSEANLREVLQFCYQENLALLGDEVYQTNIYQDERPFISSRKVLMDLGPPISKEVQLISFHSVSKGYYGECGQRGGYFEMTNIPPETVDEIYKVASISLSPNVPAQIFMGVMLHPPQPGDISYDKFVRESTGILESLRRRARLMTDGFNSCRNVVCNFTEGAMYSFPQIRLPPRALEAAKQAAKVPDVFYCLKLLEATGISTVPGSGFGQREGVFHLRTTILPDEEDMPAIMDSFKKFNDEFMEQYEDNRGYSRL

SEQ ID NO: 1007 - protein, 171 aa, Buchnera aphidicola str. APS (Acyrthosiphon pisum)
MKKIGIFFGSDTGNTEKIAKLIQKYIGDNVSCLYDISNTSQKDIEDFNFLIFGVPTWYYGEVQCDWDDFLPTLKKINFSNKIVALFGCGDQEDYSEYFCDAIGTIYDILKKNKANIIGKWSTEDYYFEQSKALLNKKYFYGLILDEDRQANKTEYRIKQWVKQIIPYFNTH

SEQ ID NO: 1008 - protein, 481 aa, Vitis vinifera
  misc_feature (453)..(453): Xaa can be any naturally occurring amino acid
MSHKGLDYETLNENVKKVQYAVRGELYLRASELQKEGKKIIFTNVGNPHALGQKPLTFPRQVVALCQAPFLLDDPNVGLVFPADAIARAKHYLSLTSGGLGAYSDSRGLPGIRKEVAEFIGRRDGYPSDPELIFLTDGASKGVMQILNTIIRGERDGILVPVPQYPLYSAAISLFGGSLVPYYLEETANWGLDVNNLHSSVAAARSKGITVRAMVIINPGNPTGQCLSEANLKEILHFCYQENLVLLGDEVYQQNIYQDERPFISARKVLMDMGPPISKELQLVSFHTVSKGYWGECGQRGGYFEMTNIPPQTVDEIYKVASISLSPNVPGQIFLGVMVNPPTPGDISYLQFMRESKGILESLKRRAQIMTDGFNSCRNVVCNFTEGAMYSFPQIRLPPKAIEAAKKAGKVADVFYCLKLLEATGISTVPGSGFGQKEGVFHLRTTILPAEEXMPAIMESFKKFNDEFMEQYEDHRGYSRM

SEQ ID NO: 1009 - protein, 569 aa, Medicago truncatula
MSLLKAVFVWCICLGLFELSLAKGKSHYKFDVEYIYKKPDCKEHVVMGINGQFPGPTIRAEVGDTLVIDLTNKLHTEGTVIHWHGIRQFGTPWADGTAAISQCAINPGETFQYKFKVDRPGTYFYHGHYGMQRAAGLYGSLIVDLPKSQREPFHYDGEFNLLLSDLWHTSSHEQEVGLSSAPMRWIGEPQNLLINGRRQFHCSLASKYGSTNLPQCNLKGGEECAPQILHVEPKKTYRIRIASTTSLASLNLAISNHKLIVVEADGNYVHPFAVDDIDIYSGETYSVLLTTDQDPKKNYWLSIGVRGRKPSTPQALTILNYKPLSASVFPTSPPPVTPLWNDTDHSKAFTKQIISKMGNPQPPKSSHRSIHFLNTQNKIGSFTKWAINNVSLTLPTTPYLGSIKFNLKNTFDKNPPPERFPMDYDIFKNPVNPNTTTGNGVYTFQLNEVVDVILQNANQLNGNGSEIHPWHLHGHDFWVLGYGEGRFRPGVDERSFNLTRAPLRNTAVIFPYGWTALRFKADNPGVWAFHCHIEPHLHMGMGVIFAEAVHKVRNIPKEALKCVLQPRCS

SEQ ID NO: 1010 - protein, 173 aa, Moritella sp. PE36
MKIGLYYGSTTFYTTIAAEKIQAEIGAELVDLHDIKDSGFTDIETYDVVIFGISTWDYGELQEDWGDLWSDIAGINLAGKTVALFGLGDQVNYSEWYLDAMGMLFDELQGKGIHFIGQWPNQGYEFVASKALTEDESQFFGLALDEDSQYDQTDERIATWSLQVLEEIAAHYS

SEQ ID NO: 1011 - protein, 520 aa, Trametes hirsuta
MSRFQSLLTFINISLVAVAHAAVGPVADLTITDAAVSPDGFSRQAVVVNGVTPGPLVAGNIGDRFQLNVIDNLTNHTMLKSTSIHWHGFFQHGTNWADGPAFINQCPISPGHSFLYDFQVPDQAGTFWYHSHLSTQYCDGLRGPFVVYDPNDPHASRYDVDNDDTVITLADWYHTAAKLGPRFPGGADATLINGKGRAPSDSPAELSVIKVTKGKRYRFRLVSLSCNPNHTFSIDGHNLTIIEVDSVNSQPLEVDSIQIFAAQRYSFVLDANQAVDNYWIRANPNFGNVGFDGGINSAILRYDGAPAVEPTTNQTTSVKPLNEVDLHPLVSTPVPGSPSSGGVDKAINMAFNFNGSNFFINGASFVPPTVPVLLQILSGAQTAQDLLPSGSVYVLPSNASIEISFPATAAAPGAPHPFHLHGHTFAVVRSAGSTVYNYDNPIFRDVVSTGTPAAGDNVTIRFDTNNPGPWFLHCHIDFHLEGGFAVVMAEDTPDVKAVNPVPQAWSDLCPTYDALDPNDQ

SEQ ID NO: 1012 - protein, 468 aa, Burkholderia cenocepacia J2315
MSRLVVVSNRIADPRKAAAGGLAVAVKDSLQETGGVWFGWSGRLRGGDDQAARGDDVQIQNVGGIQLATIDLDPQDYDAYYLGYSNNVLWPVFHYRLDLAQFDRRFADGYRRVNQLFARKLSTLLRPDDVIWVHDYQLIPLAAELRAMGCTNPIGFFLHIPMPPPPIMAAIPEHEWLMRSLFAYDLVGFQTESDLLHFEHYVEAEAGAARLPDGRLRAFGRTLSAGAFPIGINVDEFESLARDRDGLDMFERMRDEYSRRQLLVGVDRLDYTKGLPQRVHAFRQLLEQYPENRDRATLIQIAAPSREDLGAYDDLRREMDSLCGAINGDYGELEWMPMRYIHRTVARKRLPGLYRASRVALVTPLRDGMNLVAKEFLAAQDAADPGVLVLSRFAGAAEQLKSALLVNPYDTQGTAQAIQRALTMPLEERRQRHAALMAIMRKTDVHWWRTRFLEALTEAAEVAAAAES

SEQ ID NO: 1013 - protein, 520 aa, Trametes hirsuta
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDPHASLYDVDNDDTVITLADWYHTAAKLGPAFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPNFGNVGFAGGINSAILRYDGADPVEPTTTQTTPTKPLNEVDLHPLATMAVPGSPVAGGVDTAINMAFNFNGTNFFINGASFVPPTVPVLLQIIRRAQNAQDLLPSGSVYSLPSNADIEISFPATAAPPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDVNDQ

SEQ ID NO: 1014 - protein, 473 aa, Zea mays
FAAVVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDAIAAGITSRDGFPANADDIFITDGASPGVHMMMQLLIRNEKDGILCPIPQYPLYSASIALHGGALVPYYLDEKTGWGLEISDLKKQLEDARSKGIDVRALVVINPGNPTGQVLAEDNQYDIVKFCKNEGLVLLADEVYQENIYVDNKKFNSFKKIARSMGYGEDDLPLVSFQSVSKGYYGECGKRGGYMEITGFSAPVREQIYKVASVNLCSNITGQILASLVMNPPKVGDESYASYKAEKDGILQSLARRAKALEDAFNTLEGFSCNKAEGAMYLFPQIHLPHKAIEAAKAAKKAPDAFYALRLLESTGIVVVPGSGFGQVPGTWHVRCTILPQEDKIPAVITRFKAFHEAFMAEYRD

SEQ ID NO: 1015 - protein, 521 aa, Rigidoporus microporus
MPSFASLKSLVVLSLTSLSLAATVALDLHILNANLDPDGTGARSAVTAEGTTIAPLITGNIDDRFQINVIDQLTDANMRRATSIHWHGFFQAGTTEMDGPAFVNQCPIIPNESFVYDFVVPGQAGTYWYHSHLSTQYCDGLRGAFVVYDPNDPHLSLYDVDDASTVITIADWYHSLSTVLFPNPNKAPPAPDTTLINGLGRNSANPSAGQLAVVSVQSGKRYRFRIVSTSCFPNYAFSIDGHRMTVIEVDGVSHQPLTVDSLTIFAGQRYSVVVEANQAVGNYWIRANPSNGRNGFTGGINSAIFRYQGAAVAEPTTSQNSGTALNEANLIPLINPGAPGNPVPGGADINLNLRIGRNATTADFTINGAPFIPPTVPVLLQILSGVTNPNDLLPGGAVISLPANQVIEISIPGGGNHPFHLHGHNFDVVRTPGSSVYNYVNPVRRDVVSIGGGGDNVTFRFVTDNPGPWFLHCHIDWHLEAGLAVVFAEDIPNIPIANAISPAWDDLCPKYNANNPDSGLA

SEQ ID NO: 1016 - protein, 480 aa, Picea sitchensis
MAPRPLDYECINENVKKVAYAVRGELYLRASELQKEGKKIIFTNVGNPQALGQRPLTFPRQVMALCQAPMLMDDPNVSILFPADVIARAKHYLAMTTGGLGAYSDSRGLPGIRKEVAEFIERRDGYPSDPDLIFLTDGASKGVMQILNTIIRDEKDGILVPVPQYPLYSAAISLFGGTLVPYYLDESANWGLDVGDLRKSVLEARYKGITVRAMVIINPGNPTGQCLSRDNIKELLEFCYAENLVLLADEVYQQNIYQDERPFVSAKKVLMDMGLPFSKELQLVSYHTVSKGYWGECGQRGGYFEMTNIPPKTVDEIYKVASISLSPNVPGQIFLGLMVNPPKPADISYQRFVAESKAILESLRRRAHLMTDGFNNCRNVICNFTEGAMYSFPQIKLPPKAIAAAKEAGKAPDVFYCLKLLEATGMSTVPGSGFGQKEGVFHLRTTILPPEEEMPEIMNVFKIFNDDFMAKYENYSWSRL

SEQ ID NO: 1017 - protein, 422 aa, Vitis vinifera
MENGTNKWGFEDAENGPDTTTTITIKGLISLLMANIDEGNNKRLISLGMGDPSVYTCFHTSHVATESVVDAVESNKYNGYAPTSGLPQARKAIAEYLSRDLPYKLSLDDVFITSGCTQAIDVALSILARPGANILIPNPGFPIYQLSASFRGLEVRYYDLLPEKGWEADLDAIKALADQNTVALVIINPNNPCGSVYSYQHLKKTAETARKLSIPVIADEVYGHLAFGGNPFVPMGVFGSIVPVLTLGSLSKRWIVPGWRLGWFVITDPSCLFITPKIVERLKKYFDILGGPATFIQAAVPRIMEQTDGTFFKKTINILKQASDICLEKIQEIPCITCPHKPEGSMAVMVKLNLSLLEDINDDIDFCFKLAKEESVIILPGVAVGLKNWLRITFAADPSFLEEGLERIKSFYHRHSNIQHSN

SEQ ID NO: 1018 - protein, 402 aa, Streptomyces coelicolor A3(2)
MEFRQSNKLSEVCYEIRGPVIEHANALEEAGHSVLRLNTGNPALFGFEAPEEIVQDMIRMLPRAHGYTDSRGILSARRAVAQRYQALGLEVDVDDVFLGNGVSELISMAVQALLEDGDEVLIPAPDFPLWTAVTTLAGGKAVHYLCDEQAEWYPDLADMEAKITDRTKAVVIINPNNPTGAVYPKEIVEGILDLARRHGLMVLADEIYDQILYDDAVHHSAASLAPDLVVLTFCGLSKTYRVAGFRSGWLVVTGPKQHARDYLEGLTMLASMRLCANAPAQYAIQAALGGRQSIRELTAPGGRLHEQRDVAWEKLNEIPGISCVKPKGALYAFPRIDPAVHKIHDDERFVLDLLLREKIQVVQGTGFNWPSPDHFRILTLPHAEDLEAAIGRIGRFLSGYRQ

SEQ ID NO: 1019 - protein, 509 aa, Cyanobium sp. PCC 7001
MTPPTTMLASQESVSTTSGFGSSSFVLVYHRSPYDLKTAADGSVEFVDQKSPNGIIPTLRNLFQEERSGTWISWREDADAANAPDERLTVPSASPFTLRRLPLTKEQISSFYHVTSKESFWPILHSFPGLFSVDNSDWDTFVEVNQSFARAACEEAAQGATIWVHDYNLWLVPAQIRELRPDVRIAFFHHTPFPSNDVFSILPWRDEILDSLLCCDLVGFHIPRYADNFSRTAINLRGARCGDPVPVAEKFRHFGSALAQPTVMPWLEHNGRRVHIQASPVGTSPDVIREIVASEEVRTMAAQIAEQHAGRKLIISASRVDYTKGNEDMLLSYERVLENNPKWHGKVELFLACVAAASGMRIYEDIQRSVEEITGRINGRFGRIDWTPVRLSTRRTPYNELVAWFTQSDVCWITPLRDGLNLVAKEYVAARQGRDGVLVLSEFSGASVELEDAVVTNPYSHHSMDNAILKALTMPKDEQVRRMASMSEAVEEFTVQHWAEQELGALRAI

SEQ ID NO: 1020 - protein, 469 aa, Burkholderia pseudomallei K96243
MSRLIIVSNRVAPISEGEPAAGGLAIGVYDALKETGGMWFGWSGEVIASGVPQIRIEEHGPVTFATIGLSRRDYDQYYRGFSNATLWPAFHYRADLIQFDRHEFEGYSRVNVWLAQQLVPLLRDDDVIWVHDYHLIPFARALRTAGVKNRIGFFLHIPFPAAQVLVNVPPHRELVEALCSFDLLGFQTDTDLRAFFEYVEYEAGGTVDRAAHPARVDAFGRTLRAAAYPIGVYPDEIAALAKAGENGRAVKSLAASLRGRQLVMSVDRLDYSKGLVERFRAFEKLLEHETSFRNRVSFLQIAPSTRADLRAYQDIRRQLEGESGRINGRFAELDWAPILYIHRQYERPVLAALYRLARVGYVTPLRDGMNLVAKEYVSAQDPDDPGVLVLSRFAGAACELTGALIVNPIDIGGMADALSRALSMPLAERRARHADMLARLRENNVSVWRDHFLRDLGRQRAASGAGRGR

SEQ ID NO: 1021 - protein, 390 aa, Helicobacter pylori J99
MPYSSKVQSLSESATIAISTLAKELKSQGKDILSFSAGEPDFDTPQAIKDAAIKALNDGFTKYTPVAGIPELLKAIAFKLKKENNLDYEPSEILVSNGAKQSLFNAIQALIGEGDEVVIPVPFWVTYPELVKYSGGVSQFIQTDEKSHFKITPKQLKDALSPKTKMLILTTPSNPTGMLYSKAELEALGEVLKDTKVWVLSDEIYEKLVYKGEFVSCAAVSEEMKKRTITINGLSKSVAMTGWRMGYAASKDKKLVKLMSNLQSQCTSNINSITQMASIVALEGLVDKEIETMRQAFEKRCHLAHAKINAIEGLNALKPDGAFYLFINIGSLCGGDSMRFCHELLEKEGVALVPGKAFGLEGYVRLSFACSEEQIEKGIERIARFVKSKG

SEQ ID NO: 1022 - protein, 506 aa, Frankia sp. EAN1pec
MSDIDLLDLPLVLLSNRGPVSFDRDASGRTVNRGAGGLVSALSGLAEHLDDAVWVCGAATPEDAAVAGENDGGAILVQTQPTPHVVEGQPDGPSIRVRLVVTDPDAYADFYSVWSNPILWFIQHGLYGRSLAPVLTRAEHDAFENGYAAVNRAYADAVADEVQSRGGKALVLLQDYHFYLVAEHVREQCPDVVLTHFVHIPWPGPDEWRVLPGNIRERLLRGLLGSDVVGFHTRRYARNFVLCAGELLGLPINLDDLTVTVNNRVVSARYYPISVDPAALDATLASEDVAAHMAMLRYVFLDEDRQLVLRVDRTDPSKNVVRGFLAFGTLLDQHPELVGRVSFLALLQPSRTDVPEYADYIALIGAVVAEINAKHTKEGRQPIDLRMVEDFALAVAAYSICDVLMVNAIADGMNLVAKEVAVVNRRGGVLALSEMAGSHEELGEFAVTLHPFDVQQMADALYTALTMPMEERHRRLAAAAEQVRTHDVRRWLNDQLADLRHLAGFS

SEQ ID NO: 1023 - protein, 482 aa, Hordeum vulgare
MAATVAVDNLNPKVLKCEYAVRGEIVIHAQRLQEQLKTQPGSLPFDEILYCNIGNPQSLGQQPVTFFREVLALCDHPDLLQREEIKTLFSADSISRAKQILAMIPGRATGAYSHSQGIKGLRDAIASGIASRDGFPANADDIFLTDGASPGVHLMMQLLIRNEKDGILVPIPQYPLYSASIALHGGALVPYYLNESTGWGLETSDVKKQLEDARSRGINVRALVVINPGNPTGQVLAEENQYDIVKFCKNEGLVLLADEVYQENIYVDNKKFHSFKKIVRSLGYGEEDLPLVSYQSVSKGYYGECGKRGGYFEITGFSAPVREQIYKIASVNLCSNITGQILASLVMNPPKASDESYASYKAEKDGILASLARRAKALEHAFNKLEGITCNEAEGAMYVFPQICLPQKAIEAAKAANKAPDAFYALRLLESTGIVVVPGSGFGQVPGTWHFRCTILPQEDKIPAVISRFTVFHEAFMSEYRD

SEQ ID NO: 1024 - protein, 490 aa, Durio zibethinus
MEFTRKNKQLLSRKATNDGHGENSPYFDGWKAYDSDPYHRSQNPNGVIQMGLAENQLCFDLIKKWILENPDASICTAEGVDKFKDIAIYQDYHGLKEFIEALAKFMGRVGGNRVTFDPNRIVMSGGATGANETVMFCLADPGDAFLVPSPYYPAFARDLRWRTGLEIVPVDCKSSNNFRITRAALEEAYEKAQRSNINVKGVIIANPSNPLGTILDRETMRSIVSFINEQNIHLVFDEIYAATVFSSPRFISIAEIIQDMDCNRDLIHIVYSLSKDMGFPGFRVGIVYSFNDVVVNCARKMSSFGLVSSSQTQYLLASMLSDEDFVGNFLRESSKRLAKRHHVFTKGLEQVGISCLKSNAGLFFWMDMRPLLKEQTVKGEMELWRVIIDEVKLNVSPGSSFQCSEPGWFRVCFANMDGETVEVALDRIRKFVLQGKEEDHAAPETSKRWQKKNLRLSFSSSRLYDESTMSPPMISPHSRIPHSPLVPAMT

SEQ ID NO: 1025 - protein, 202 aa, Oryza sativa
  misc_feature (84)..(84): Xaa can be any naturally occurring amino acid
  misc_feature (97)..(97): Xaa can be any naturally occurring amino acid
  misc_feature (110)..(110): Xaa can be any naturally occurring amino acid
  misc_feature (116)..(116): Xaa can be any naturally occurring amino acid
  misc_feature (130)..(130): Xaa can be any naturally occurring amino acid
  misc_feature (134)..(134): Xaa can be any naturally occurring amino acid
  misc_feature (139)..(139): Xaa can be any naturally occurring amino acid
  misc_feature (141)..(142): Xaa can be any naturally occurring amino acid
  misc_feature (156)..(156): Xaa can be any naturally occurring amino acid
  misc_feature (160)..(160): Xaa can be any naturally occurring amino acid
  misc_feature (165)..(165): Xaa can be any naturally occurring amino acid
  misc_feature (168)..(168): Xaa can be any naturally occurring amino acid
  misc_feature (181)..(181): Xaa can be any naturally occurring amino acid
  misc_feature (194)..(194): Xaa can be any naturally occurring amino acid
MTDKFVHNKTLTMENLNPRVIDVEYAVRGPIVLRAAEMEKEIQSGKHSFPFERVIRANIGDCHASGNQLPITYIRQFVAGCTYXAIMDSSDFPADIXQRVERLLASAAGXSLGSYXESQGLITIREDIAXYIEXRDGYXAXXSDIYLCNGALDGIXTVIXLLMNXDPXKPSGIMIPVPQYXLYSATLSEYGAYXIEYYLDED

SEQ ID NO: 1026 - protein, 1114 aa, Candida glabrata CBS 138
MTLIVASLFLPHRPQFEVTASAGETQELIENNLVKLNPLASNEASPQARPNLDNYIRNTRSALNVPFAQGRNVSQESLLSLNNAGNTSGNIDDLVSSEQFLVNLTANATASGTPNPSYHTKGNMGRPNLGAGGSAEEFFSTSNPPSNRGASPVLSIASAPQVQNNLDSTLNNRGSPPPQQLDSQMADPTAHLLKNVSKSLLTQSLHDSTKEASAPMPSSSANSMGQSRYNHANTSIGTAVTPKSRPLPGHSNSSSIIDFSLSRNKQHAPALPALRRIQKNKVGSPTKPSPLNTQPQSSNLKYSKTLHQMHGDSAYNSDWTTGDDSDHLEEHEEPDNDDDLRQEYLVPQFGGFSTTSKVRETLLKSSRELFAQLPWTIVNSDKGNGSLKNAVNTAVNEKTTKENVKWVGTMGIPTDEIPDEIVENIAKVMEEQYNCGAVVTDDITFKGAYKNYCKQILWPTLQYQIPDNPKSKAFEDHSWQYYHRLNQQFAEKIINVYKDGDIIWIHDYHLMLVPGMVREVFPDAKIGFFLHVSFPSSEVFRCLAHREEILEGLIGANSLGFQTKEYARHFLQTSNRLLAADVSDDELKYDGRIVSVKQVPVGIDYFTLREKLKDENVLQWRHLIKERWHGKKLIVCRDQFDRIRGLYKKMLAYERFLKDNPQYIENVVLVQVCIGKSTDLELERQIMVVVDRINSMSPNISLIQPVVFLHQELDFPQYLALNSEADLFMVNALREGMNLTCHEFIGCSSDKNAPLILSEFTGSSSVLSEGAMLVNPWDIKQVAACIKEGLEMSREEKKRNWKKMVKSVITHDSDSWFVSCLQNLNNSWEFTKERSTVFNLRFETFSDDYNDTSKRLFIFKISEPPNSRMISVLNELSSKNRVYIMNSFSKVVNESLYSRVNNIGLIAENGAFVRLNGDWYNIVEDVNWRAEVVKILEDKVERLPGSYYKIADSMIRFHTENAEDQERVSGVIGEAITHINTLFDDAGIHAYLHKNIVFVQQTGLSLNAVKFLLRYYNTAASGDNVTPMINSEQSPRSRSDSISVSQKPIDFLCISGSSSPVIEPLFKLVKDQRNSGMLRHGHSIVYGDTTSSYAREHVNGSNGLFNVLNRLMRS

SEQ ID NO: 1027 - protein, 594 aa, Hortaea acidophila
MAAHLLLGALMLGSALAISYHKPAWIPLGDSLSPRLGQDVTNGNGVLGTLDAPRLAKFLPDTHASRHRRKGYSPTDIGIGDVPVTGVTRYYNFTITEQNIAPDGVVRSGMVVNGGYPGPTIEANWGDYFEISVVNALPNEGTSIHWHGLIQHETPYMDGVPGIVQCPIAPGGNFTYRFRADLYGTSFYHSHYSAQYTGGIYGAMIIHGPTENAQYDEDIGPVLLNDWYHLPPPQSNNNLINGKMNVSRQRCTPNAGISKFTFQSGKTYRLRLINAGAEGMQKFSIDGHTMTVIANDFVPLKPYQTDVVTLGIGQRSDIIVTATGKAGQSYWMRSDLGLNALSNPAGCTNNDGVSPLALAAIYYEGADTNSVPTTNSTVPESSIQSCMNDPLNMTVPYYSLTPSTTPAMSQNIDITFASNGTNYLFYMNNSTFRADYNDPILLEAKLGQTVFPAEENVISTGNASSVRFVLYNYAFTGAHPMHMHGHNYWVLAEGYGTWDGTVTNAGNPQRRDVQLLPPAQVNADLVVTSPSYIVLQFNADNPGVWPLHCHIAWHVSAGLYVSILENPTAIKSMHIPKPAAWTGKDVPDQIDSGL

SEQ ID NO: 1028 - protein, 521 aa, Flammulina velutipes
MVRFQSFLPYLALFFAASAYAAIGPVADLVISNADVTPDGFTRAAVVVNEAFPSPLITGYKGDHFRLNVINRMTNHTMLKTTSIHWHGLFQRGTNWADGPAFVTQCPIASGDSFLYDFRVPGQAGTFWYHSHLSTQYCDGLRGPSVVYDPLDPLGWLYDVDDDSTVITLADWYHFAARLGPRFPAGLANSTLINGLGRSPDAPGADLAVVNVTHGKRYRFRLVSLSCDPSYTFSIDGHELTVIEADGVDTYPVTVNAIEIFAAQRYSFVLTANQTIDNYWIRANPNLGNLGFADGINSAILRYDGANAVEPVTSQQSTQILLKETDLHPFIPRWTPGRPEPGGVDLALNMAFDFNGTNFFVNNATFDPPPVPVLLQILSGKHAAQDLLPSGSVYALPSHSSIEITFPATARAPGGPHPFHMHGHVFAVVRSAGSSTYNYRNPVWRDTVSTGTSAANDNVTIRFRTDNPGPWFLHCHIDFHLQAGFAIALAEEIPRIPLANPVTYEWSRLCPVYDALAPEDQ

SEQ ID NO: 1029 - protein, 1000 aa, Gossypium raimondii
MSKIKGTKKLVSAHLTLPQGLNQKNIKPNAALNREIAPPIISCHLIIMTSLVTSFTSMSSRIPQNTFVRITWRCREQGKCKNEVMFKYGGGPQIVQVPFKWFSDTVLGQYEEHVIHSSPLFNEDDAWGHRVALNNTRGDSPVSHMISLLKPNADLASGNFPAMGQPREKKRLPRVMTVPGVISELDDDQANSVTSDAPSSAIQDRIIIVANQLPVKAKRRPDNKGWSFSWDDDSLLLQLKDGLPEEMEVLYVGSLKVDVDPVEQDDVSQLLLDKFKCVPAFLPSDILTKFYHGFCKQHLWPLFHYMLPFSASHGGRFDRSLWEAYVAANKIFSQRVIEVINPEDDYVWIHDYHLMVLPTFLRRRFNRLRMGFFLHSPFPSSEIYRTLPVREEIMKALLNSDLIGFHTYDYARHFLSCCSRMLGLEYQSKRGYIGVEYYGRTIGIKIMPVGIHMGQIKSVLSLADKEWRVAELKQQFEGKTVLLGVDDMDVFKGIDLKLLAMEQMLKQHPKWQGRAVLVQIANPSRGRGKDLEDIQAEIQASCKRINETFGQPGYEPIVLIDRPVSLCERFAYYTIAECVVVTAVRDGMNLTPYEYIVGRQGVSESESSSESSGPKKSMLVVSEFIGCSPSLSGAIRVNPWNTESTAEAMNEAISMSDAEKQLRHEKHYRYVSSHDVAFWSRSFFQDLERTCKDHFRRRCWGIGLSFGFRVVALDPNFGKLSIDHIVSVYLRSKNRAILLDYDGTVMPQTSHNKTPSAEVISIINALSGDTKNTVFVVSGRGRESLGKWFSPCKKLGIAAEHGFFMRWSANDEWELCGQNSEFGWKQIAEPVMKLYTESTDGSSIETKESALVWHHRDADPGFGSSQAKEMLDHLESVLANEPVAVKSGQFIVEVKPQGVSKGMVAEKIFTTMSEKGKQADFVLCIGDDRSDEEMFEIISNAISSGILSSSTSVFACTVGQKPSKARYYLDDPAEVLNMLEALAEASDPESFTDTESEGSL

SEQ ID NO: 1030 - protein, 152 aa, Bacillus pumilus SAFR-032
MTEKVLLVYATMSGNTEAMADLIEKGITEAGAGVDRHEAMDIDAELLNDYTHIMLGAYTWGDGDLPDDFIDFYEEMEELDLTGKAFAVFGSGDTSYEHFCGAVDLIEEKVKELGGDIVLPSVKIELNPEGEEEEKLISFGKQFVHLHQQEAG

SEQ ID NO: 1031 - protein, 520 aa, Phlebia tremellosa
  misc_feature (337)..(337): Xaa can be any naturally occurring amino acid
MFSFARSTALVVAGLFVGAIAAIGPVTDFHIVNAAIAPDGISRQAVLAEGTFPGPLITGNKGDNFQINVIDELTNATMLKSTTIHWHGFFQHGTNWADGPAFVNQCPIATGNSFLYNFNAPDQAGTFWYHSHLSTQYCDGLRGPFVVYDPNDPYADLYDVDDDSTVITLADWYHTAARLGGPFPNADTTLINGLGRCGEPGAPVSDLAVINVEAGKRYRMRLVSISCDSWFNFTIDGHDMTIIEVDGVNHETLTVDQIQIFAAQRYSFILEANQPVDNYWIRANPGTGITQGFEGGINSAILRYAGADEVEPTTALVASTSPLAEGDLHPLDNPAAXGQPFPGGVDYALNLNLTFDGPTLKFLINGVSFVPPTVPVLLQILSGAQTAQDLLPTGSVYSLPSNATIELSLPAGPAGGPHPFHLHGHTFSVVQGAGQTVPNYVNPVRRDVVSIGAVPDNVTIRFETNNPGPWFLHCHIDWHLDAGFAVVFAEDIPDIASVSPVPTDWSNLCPIYDALDPSDQ

SEQ ID NO: 1032 - protein, 518 aa, Pycnoporus cinnabarinus
MSRFQSLLSFVLVSLAAVANAAIGPVADLTLTNAAVSPDGFSREAVVVNGITPAPLIAGQKGDRFQLNVIDNLTNHTMLKTTSIHWHGFFQHGTNWADGVSFVNQCPIASGHSFLYDFQVPDQAGTFWYHSHLSTQYCDGLRGPFVVYDPNDPQASLYDIDNDDTVITLADWYHVAAKLGPRFPLGADATLINGLGRSPGTTTADLAVIKVTQGKRYRFRLVSLSCDPNHTFSIDGHTMTVIEADSVNTQPLEVDSIQIFAAQRYSFVLDASQPVDNYWIRANPAFGNVGFAGGINSAILRYDGAPEVEPTTTQTTSTKPLNEADLHPLTPMPVPGRPEAGGVDKPLSMVFNFNGTNFFINNHSFVPPSVPVLLQILSGAQAAQDLVPDGSVYVLPSNSSIEISFPATANAPGTPHPFHLHGHTFAVVRSAGSSEYNYDNPIFRDVVSTGQPGDNVTIRFQTNNPGPWFLHCHIDFHLEAGFAVVLAEDTPDTAAVNPVPQSWSDLCPIYDALDPSDL

SEQ ID NO: 1033 - protein, 517 aa, Aspergillus niger
MPSLENPTFQNEARLLLVSNRLPITIKRSDDGRYDFSMSSGGLVSGLSGLSKSTTFQWYGWPGLEVPEEEIPVVKERLKQEYNAVPVFIDDELADRHYNGFSNSILWPLFHYHPGEITFDESAWEAYKEANRLFAKAVAKEVQDGDLIWVHDYHLMLLPEMLREEIGDSKENVKIGFFLHTPFPSSEIYRILPVRNELLLGVLHCDLIGFHTYDYTRHFLSACSRLLGLTTTPNGIEFQGKIIACGAFPIGIDPEKFEEGLKKEKVQKRIAMLEQKFQGVKLMVGVDRLDYIKGVPQKLHALEVFLSDHPEWVGKVVLVQVAVPSRQDVEEYQNLRAVVNELVGRINGKFGTVEFMPIHFLHKSVNFDELIALYAVSDACIVSSTRDGMNLVAYEYIATQKKRHGVLVLSEFAGAAQSLNGSIIINPWNTEELAGAYQEAVTMSDEQRALNFSKLDKYVNKYTSAFWGQSFVTELTRISEHSAEKFHAKKASFSDNNSENGEPSNGVETPAQEQVAQ

SEQ ID NO: 1034 - protein, 472 aa, Burkholderia pseudomallei K96243
MSRLIVVSNRVAAGQDARPTAGGLAVGVLDALKETGGVWFGWNGEIAGAPEEPVIERDGNVTYATVGLTRRDYDQYYRGFSNATLWPVFHYRGDLARFDRQEYAGYLRVNCALAKQLCALVQPDDIIWVHDYHLLPFAHCLRELGVKNPIGFFLHIPFPSPEVLRTVPPHEELMKFMCAYDVIGLQTESDKQAFVDYIERRGLGTSSEDGILHAHGRVVKVAAYPIGIYPDAIGKAAIEYGSRKAVKALRDTMRERKLVISVDRLDYSKGLVERFQAFERMLANAPGWQGRVSLVQIAPPTRSDVQTYQRIRQTLEGEAGRINGRFAQLDWTPIQYLNRKYERNLLMALFRLSQVGYVTPLRDGMNLVAKEYVASQDPNDPGVLVLSEFAGAAAELPGALLVNPFDLSQMAESLERALAMPLEERQARHAENIARLRKNDLSVWRDSFLTDLRSVATAASVTQRAGRRVANA

SEQ ID NO: 1035 - protein, 499 aa, Trametes versicolor
GIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 1036 - protein, 908 aa, Monostroma angicava
MTPGPITTDAAAGVGVDTTDGTMKWELFEENRTLTTRSGQMIVNDGEFGKWNDTDEGRVKCFLTPDEGFGDAIESLVIVLYRLPIIAKRDATTGAWSFKWDDDALYLTSTGLRKGLEQLKVAPLWVGILNSDDEVPRQEREGVADRLLEEFNCVPVFIPHDTLKQFYQGFCKGTLWPLFHMVSSATDHTEHTTRFDDRLWRVYMNVNRMFRDKVVEVYDGDRALIWVHDYHLMLLPQASRSRLSGVKIGFFLHIPWPSSEVYRVLPWRNELLKGMLSATLLGFHLFDYARHFLSACVRLLNLEHEANRGSLGLEYDGRHVMLRVSHIGVDPERFSEGLSAPSLTDRVAEFKERFADCTVLGAVDDLDLIKGIALKLMGFQRYLDSAPKMRGKVVLVQVAIPKAARVKESVRNEIRELVAAINNKHGDGSGRRPVWYLEESISFESRLALYSIMDALVVTPIRDGLNLIPYEYIVSTSEGKGQLILSEFTGCSRALSSAERVNPWDLEKLSNVLDMVVQKAIAAAPEVELKRRADKAYVSAHSSQQWAQSFLHDLKEASEPAQVVVKVGPLAGLPGVLAYDEFTLLNRSAVLRAYKAAKRRLFLFDYDGTLTSITDQSSQMAHAWARPSEAVAANLDTLSKDPLNDVYIMSGRKTEVLEAGLNNSPTIGIAAEHGFFYRKKNSKEWNRLLEDADLSWMELALRIMLMYTDRTDGSYVEQKKAGLVWHYLDADREFGSWQAKEMRDHLESLLSPFSVQVVTGYGWLQVRMAAMNKGVMVETILRDMPEPPDFVLCCGDDRTDEDMFAYLDTHLDPSVKQFTCTVGVKPSHARYYLHSSNEVGALLETLVTGSYPRGVRPRPRGGSVSLADLVPDDEGSSSTPAVPQRTNGPRTSASGQKRRGLASSLPSQ

SEQ ID NO: 1037 - protein, 417 aa, Nocardia farcinica IFM 10152
MGHVSPHLPHRPPRVLEQSTKLQNVVYEIRGPVHAHAARLEAEGHRILKLNIGNPAPFGFEAPDVIMRDIIAALPYAQGYSESKGILSARRAIVTRYELVPGFPEFDVDDVYLGNGVSELITLTMQALLDNGDEVLIPAPDYPLWTAMTSLAGGTPVHYLCDESNGWQPDIADIEAKITDKTKALLVINPNNPTGAVYSAEVLQQIVDLARKHQLLLLADEIYDKILYDDAKHISLATLAPDLLCLTFNGLSKAYRVAGYRSGWMVITGPKEHATGFLEGIDLLATSRLCPNVPAQHAIQVALGGHQSIEDLILPGGRLLEQRDVAWERLNMIPGVSCVKPKGALYAFPRLDPEVYEIHDDSKLILDLLLQEKILMVQGTGFNWPAHDHLRIVTLPWARDLAVAIERFGNFLASYRQ

SEQ ID NO: 1038 - protein, 898 aa, Musa acuminata
MLILILAVFVPSYTEEPRCLNSELWHACAGPLVSLPAVGSRVAASTNKEVDSQIPNYPSLPPQLICQLHNVTMHADVETDEVYAQMTLQPLSAQEQKDPYLPADLGTPSKQPTNYFCKTLTASDTSTHGGFSVPRRAAEKVFPPLDFSQQPPAQELVARDLHGNEWKFRHIFRGQPKRHLLTTGWSVFVSAKRLVAGDSVLFIWNENNQLLLGIRRANRPQTVMPSSVLSSDSMHIGLLAAAAHAAATNSRFTIFYNPRASPSEFVIPLTKYVKAVYHTRVSVGMRFRMLFETEESSVRRYMGTITGISDLDPVRWPNSHWRSVKVGWDESTAGEKQPRVSLWEIEPLTTFPMYPSSFPLRFKRPWPTGLPFFHGGRDDEFSLNSPLMWLRDGGNPALQSLNFQGVGVTPWMQPRLGTSMLALQPDMHQTVAAVALQEMQTMDLTKQVTPAMLQFQQPQNTTSRSTPILQSQILQHAQPQSHQPLLHTIQGNQMQSQAQSQFLQHHLQQGHSFAEQQQQQQHNLQLQIPEHQQFQQQRVLPAYQQVPYGAANLSQLSSSSQSQSTTLNMISPSSQLKDFPDSNGNSVSASSVSPLDNILHQISPEETSQLLSLPRYAQPVTSNPWSSKRIAVESMLPSGAQSVLSQVEQIGSGQPNIPLQSVVLPPFPGRECSMNQDGNMDIQNQHMFGVNIDSSISVQNGIRSLGTGVNGTNSTNIPYAACNLLRSAGNDFPINQAVNGSNGLDESGLLQSTENVDRVNSQSGTFVKVYKSGSFGRSLDITRFSSYHELRSELGHLFGLEGQLEDPLRSGWQLVFVDREDDVLLVGDDPWQEFVNSVSCIKILSPEEVQQMGKQGVDFVNSAPIKRLQSNGCDDYVSQQHSRNLSAARITSVGSFKY

SEQ ID NO: 1039 - protein, 908 aa, Porphyra haitanensis
MTPGPITTDAAAGVGVDTTDGTMKWELFEENRTLTTRSGQMIVNDGEFGKWNDTDEGRVKCFLTPDEGFGDAIESLVIVLYRLPIIAKRDATTGAWSFKWDDDALYLTSTGLRKGLEQLKVAPLWVGILNSDDEVPRQEREGVADRLLEEFNCVPVFIPHDTLKQFYQGFCKGTLWPLFHMVSSATDHTEHTTRFDDRLWRVYMNVNRMFRDKVVEVYDGDRALIWVHDYHLMLLPQASRSRLSGVKIGFFLHIPWPSSEVYRVLPWRNELLKGMLSATLLGFHLFDYARHFLSACVRLLNLEHEANRGSLGLEYDGRHVMLRVSHIGVDPERFSEGLSAPSLTDRVAEFKERFADCTVLGAVDDLDLIKGIALKLMGFQRYLDSAPKMRGKVVLVQVAIPKAARVKESVRNEIRELVAAINDKHGDGSGRRPVWYLEESISFESRLALYSIMDALVVTPIRDGLNLIPYEYIVSTSEGKGQLVLSEFTGCSRALSSAVRVNPWDLEKLCGVLDMVVQKAIAASPEVELKRRADKAYVSAHSSQQWAQSFLHDLKEASEPAQVVVKVGPLAGLPGVLTYDEFTLLNRSAVLRAYKAAKRRLFLFDYDGTLTSITEQSSQMAHAWARPSEAVAANLDTLSKDPINDVYIMSGRKTEVLEAGLNNSPTIGIAAEHGFFYRKKNSKEWQRLLEDADLSWMELTLRIMLMYTDRTDGSYVEQKTAGIVWHYLDADREFGSWQAKELRDHLESLLTPFSVQVVSGYGWLQVRMAAMNKGVMVETILQDMPEPPDFVLCCGDDRTDEDMFTYLDTHLDPSVKQFTCTVGVKPSNARYYLHSSNEVGALLETLVTGSYPRGVRPRGRGASISLADLVPDDEGSSSTPPMPQRTNGPRTSASGQKRRGLASSLPSQ

SEQ ID NO: 1040 - protein, 484 aa, Physcomitrella patens subsp. patens
MPKKNPVSIQSINPKVLNAEYAVRGEIVIRAQALAEELKSNPGSHPFDEIIYCNIGNPQSLGQKPITFFREVVALCDHPSLLDKPETHALFSSDAISRASRIINKIPGQTTGAYSHSQGVTVCRDDIAAGIAARDGYPANPEDIFVTDGASPGVHMMMQLLLSSEKDGILCPIPQYPLYSASIALHGGTLVPYYLNENSGWGLELNELKKRLQEAHDAGTTVRALVVINPGNPTGQVLSEENQQDIVNFCKDEGLVLLADEVYQENIYAEGKTFNSFKKVARSMGLEDKDIVIVSFQSVSKGYYGECGRRGGYMEVTGLPKDVKDQLYKLASVNLCSNVSGQILVSLVMNPPKPGDSSYEQFARERDSILSSLARRAKVLTEAMNKLEGVSCNAAEGAMYVFPRLYLPKKAQIAAGEAGMKADVFYTRRLLDSTGIVMVPGSGFGQVPGTWHVRCTILPSEENFGAIIDRLTTFHKKFMDEFRD

SEQ ID NO: 1041 - protein, 908 aa, Gracilaria lemaneiformis
MTPGPITTDAAAGVGVDTTDGTMKWELFEENRTLTTRSGQMIVNDGEFGKWNDTDEGRVKCFLTPDEGFGDAIESLVIVLYRLPIIAKRDATTGAWSFKWDDDALYLTSTGLRKGLEQLKVAPLWVGILNSDDEVPRQEREGVADRLLEEFNCVPVFIPHDTLKQFYQGFCKGTLWPLFHMVSSATDHTEHTTRFDDRLWRVYMNVNRMFRDKVVEVYDGDRALIWVHDYHLMLLPQASRSRLSGVKIGFFLHIPWPSSEVYRVLPWRNELLKGMLSATLLGFHLFDYARHFLSACVRLLNLEHEANRGSLGLEYDGRHVMLRVSHIGVDPERFSEGLSAPSLTDRVAEFKERFADCTVLGAVDDLDLIKGIALKLMGFQRYLDSAPKMRGKVVLVQVAIPKAARVKESVRNEIRELVAAINNKHGDGSGRRPVWYLEESISFESRLALYSIMDALVVTPIRDGLNLIPYEYIVSTSEGKGQLILSEFTGCSRALSSAERVNPWDLEKLSNVLDMVVQKAIAAAPEVELKRRADKAYVSAHSSQQWAQSFLHDLKEASEPAQVVVKVGPLAGLPGVLAYDEFTLLNRSAVLRAYKAAKRRLFLFDYDGTLTSITDQSSQMAHAWARPSEAVAANLDTLSKDPLNDVYIMSGRKTEVPEAGLNNSPTIGIAAEHGFFYRKKNSKEWNRLLEDADLSWMELALRIMLMYTDRTDGSYVEQKKAGLVWHYLDADREFGSWQAKEMRDHLESLLSPFSVQVVTGYGRLQVRMAAMNKGVMVETILRDMPEPPDFVLCCGDDRTDEDMFAYLDTHLDPSVKQFTCTVGVKPSHARYYLHSSNEVGALLETLVTGSYPRGVRPRPRGGSVSLADLVPDDEGSSSTPAVPQRTNGPRTSASGQKRRGLASSLPSQ

SEQ ID NO: 1042 - protein, 430 aa, Candidatus Kuenenia stuttgartiensis
MEHEGWRHLTYEIRAIVAVANELKKLGVEITWENIGDPVQKGEKIPQWIKDIVIQLVSEDKTYGYVATQGVPETRKFLADLVNKRGGYQISPDDIIFFNGLGDAVSTIFSLLKREARVIGPSPAYSTHSSAEAAHSGYDHLTYDLDPENNWLPDLNDIENKIKYNDSIAGMLIINPDNPTGSVYPRSFLEKIVEIAKRYELFLICDEIYANIVYNGAETANLSEIIGGVPGMAMRGISKEFPWPGSRCGWIEVFNQESNPEFKNYIKSLINAKMLEVCSTSLPQYAIPLIMGNPNYPAHLKMRREKYEYRAYEACEIFSKVDGIRVVKPQGAFYMSIVFKDGVLNAQQTLPIENIAVKKYILDKVSGVEVDKRFVYYLLGATGICVVPLTGFCCTRKGFRITLLEADDEKRKWTWNTIAENINKYVTPCN

SEQ ID NO: 1043 - protein, 443 aa, Bradyrhizobium sp. ORS278
MRDGAQAEPIAQIEQLGQGALALLDLPAAHYAGYYEGFANSALWPALHSRSDLIRVSQDDYNSYREVNSFVARALLKFQKQDTLFWIQDYHFLSLGAELRTLGVKSPIGFFLHTPWPARSVIDSVPNHRDLVTAMLAYDLIGFQTEDDRENFAACVRADLGLQVRNGVVTSRHGRTRLAVFPIGIDADKFAQQAAKAASHPDVSRLRRSLHGEKLAIGVDRLDYSKGLVNRINAFDRMWSVHPTLLRAASLLQIATPSRESIEAYGNLQSEVARLVSEVNGRHGEVDWTPIRYLNKGYGQGVLAGLYRSAQVGVVTPLHDGMNLVAKEYVAAQSPVDPGVLVLSKFAGAANELDAALLVNPHDIDGMARTIAMALSMPLNERRMRHQILMTKLRRHSIQQWFADFLDALQDDGAHEPVEVEPLPAASAGLLGSRFMSSTARYH

SEQ ID NO: 1044 - protein, 908 aa, Chondrus ocellatus
MTPGPITTDAAAGVGVDTTDGTMKWELFEENRTLTTRSGQMIVNDGEFGKWNDTDEGRVKCFLTPDEGFGDAIESLVIVLYRLPIIAKRDATTGAWSFKWDDDALYLTSTGLRKGLEQLKVAPLWVGILNSDDEVPRQEREGVADRLLEEFNCVPVFIPHDTLKQFYQGFCKGTLWPLFHMVSSATDHTEHTTRFDDRLWRVYMNVNRMFRDKVVEVYDGDRALIWVHDYHLMLLPQASRSRLSGVKIGFFLHIPWPSSEVYRVLPWRNELLKGMLSATLLGFHLFDYARHFLSACVRLLNLEHEANRGSLGLEYDGRHVMLRVSHIGVDPERFSEGLSAPSLTDRVAEFKERFADCTVLGAVDDLDLIKGIALKLMGFQRYLDSAPKMRGKVVLVQVAIPKAARVKESVRNEIRELVAAINNKHGDGSGRRPVWYLEESISFESRLALYSIMDALVVTPIRDGLNLIPYEYIVSTSEGKGQLILSEFTGCSRALSSAERVNPWDLEKLSNVLDMVVQKAIAAAPEVELKRRADKAYVSAHSSQQWAQSFLHDLKEASEPAQVVVKVGPLAGLPGVLAYDEFTLLNRSAVLRAYKAAKRRLFLFDYDGTLTSITDQSPQMAHAWARPSEAVAANLDTLSKDPLNDVYIMSGRKTEVLEAGLNNSPTIGIAAEHGFFYRKKNSKEWNRLLEDADLSWMELALRIMLMYTDRTDGSYVEQKKAGLVWHYLDADREFGSWQAKEMRDHLESLLSPFSVQVVTGYGWLQVRMAAMNKGVMVETILRDMPEPPDFVLCCGDDRTDEDMFAYLDTHLDPSVKQFTCTVGVKPSHARYYLHSSNEVGALLETLVTGSYPRGVRPRPRGGSVSLADLVPDDEGSSSTPAVPQRTNGPRTSASCQKRRGLASSLPSQ

SEQ ID NO: 1045 - protein, 388 aa, Sinorhizobium meliloti 1021
MTIMTSLSPRATAAPESGIVEVVNYARGREGLIPLWVGEGDLPTPDFVSRAAADALMAGETFYTWQRGIPPLREALVRYYQRRFQKALSPENFYVTGSGMQAIKLAIEAVGSPGDEVVLLTPAWPNFAAAADLSGVRPVAVPLQFEGGKWRLDPERLQAAIGERTRALFINTPSNPTGWTATHDDLKAILALAREHGLWIIADEIYALYYYPDGRAPSFLDVMEEDDRILFVNSFSKNWSMTGWRVGWIVAPPAMGQVLENLIQYSTSGVAQFMQRGAVAALDEGDGFVEENIAKAKRNRDTLCDALIATNRVETLKPDGALYAFLKIDGVTDSRAAALDIVDRTGVGLAPGTAFGEGGALFMRACFLRDPLQIAEAADRLQRYILSR

SEQ ID NO: 1046 - protein, 163 aa, Campylobacter jejuni subsp. jejuni NCTC 11168
MSVAVIYGSAMGNTEGAANTIASKLGISDVFNISDIDAAKMNSYDKLICGTSTWGSGDLQDDWDGFDFSGLSLGGKTVAVFGMGDSESYSDTFCGGMGKLAQNLKDAGANLVGEVSTDGYTFEASDAVVDGKFVGLALDNDNQEDQTESRIDAWVEQIKPYFA

SEQ ID NO: 1047 - protein, 487 aa, Zea mays
  misc_feature (50)..(50): Xaa can be any naturally occurring amino acid
MTPCALTVDSLNPKVLALADHLGDNAIARRAQCIQNEIEAEPGFSMSCVXIIDCSLSNPQSMGQRPNKFFREVLALCDYPHLLEQSGTNSLFSSGAIARAREILDLFPGRATGGYSHSQGTEGLRDIIAAGIAARDNFPCNADDIFLTDGAAPPVHMMMHLLIRDKKDGILCPVPSHSLYTSAMLLQGATLVPYFLDESRGWGVSMSDLKKQLDSARSMGVFVRGLVVINPGNPTGHVLVEENQREIVDFCRNEDLVLLADEVYQENIYADEKGFHSFKKIARSMGYGEGDISLVSFHSVSNGYYGECGRRGGYMEVTGFNSDVKKQVYKVVSLSSCSNISGQILMSLVMNPPQVGDESYASYHAERHGVLSSFARCAEAMVRSFNGLEGVTCSEAEGAVFVFPSVRLPKKAVAAAEASNTQPDAFYALRLLETTGIVVVPGSVFGQMHGTWHFRCTVLPHEEKKTMTVIISSFVAFHRAFMEEFRD

SEQ ID NO: 1048 - protein, 182 aa, Trichodesmium erythraeum IMS101
MAKIGIFYGSTSGVTEEIATALHEKIGEELCDIYSMEEDYDEYSQLLDYDYLLLGCSTWGAGEVQNDWREPLFDMDIEKPDFTGKTIALFGAADQVSHGKHFAGALQIMCDHFEKLGATVVGEFPIEGYSFEHCSAVRNGKFVGLPIDEINQSDLTEDRITQWVETLRPIFLGEESSVLLAA

SEQ ID NO: 1049 - protein, 504 aa, Coprinopsis cinerea
QIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVIYDDNDPHAALYDEDDENTIITLADWYHIPAPSIQGAAQPDATLINGKGRYVGGPAAELSIVNVEQGKKYRMRLISLSCDPNWQFSIDGHELTIIEVDGELTEPHTVDRLQIFTGQRYSFVLDANQPVDNYWIRAQPNKGRNGLAGTFANGVNSAILRYAGAANADPTTSANPNPAQLNEADLHALIDPAAPGIPTPGAADVNLRFQLGFSGGRFTINGTAYESPSVPTLLQIMSGAQSANDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTVV

SEQ ID NO: 1050 - protein, 517 aa, Trametes sp. C30
MAKFQSLLTFITLSLVASVYASIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGPAVPTADATLINGLGRSISTLNADLAVITVTKGKRYRFRLVSLSCDPNHTFSIDGHSLTVIEADSVNLKPQTVDSIQIFAAQRYSFVLNADQDVDNYWIRALPNSGTRNFDGGVNSAILRYDGAAPVEPTTTQTPSTQPLVESALTTLEGTAAPGNPTPGGVDLALNMAFGFAGGRFTINGASFTPPTVPVLLQILSGAQSAQDLLPSGSVYSLPANADIEISLPATSAAPGFPHPFHLHGHTFAVVRSAGSSTYNYANPVYRDVVSTGSPGDNVTIRFRTDNPGPWFLHCHIDFHLEAGFAVVMAEDIPDVAATNPVPQAWSDLCPTYDALSPDDQ

SEQ ID NO: 1051 - protein, 387 aa, Trichodesmium erythraeum IMS101
MNFATRMNSLGGDAAIEVFTKAKQLESQGRNIIHLEIGQPDFKTPKNIREAAFQAMNDGYTTYTPAAGLLKLREVIAEHISQTRNISVNSDEVVVMPGAKPVIFFTLLALINSGDEVIYPNPGFPVYESVINLVGGKPIPLPLLEELDFQFSIDNLVNSISEKTKLLIINSPHNPTGSVLTPEYLEAIAKLAVKHNFYVLSDEIYSHLNYDSKFTSIISFPSMKERTILLDGHSKTYAMTGWRLGYSISPKAIAEKLDKLMLNSNSCACSFTQIAGIEAIKNSQEFVKKIFAEFKQRRDVIVDGLNSISGINCRKPAGAFYAFPNVKQLPISSNKLADYLLAEAGVALLPGTAYGKFGDGYLRLSYANSIENIREGISRIETAIAKL

SEQ ID NO: 1052 - protein, 222 aa, Synechococcus sp. WH 7805
MRDDVATLTKQINEDTKKGRKLILSASRVDYTKGNEELLLAFERLLERREDLRGKVVLMLACVAAASGMKIYEDTQRLIEETAGRINGRFSLIDWVPIRFSTNRIPYEEMVAWFSMSDICWITPLRDGLNLVAKEYVAARKGRDGVLVLSEFTGASVVLDGAVLTNPYSHKQMDQAIESALEMSEDEQIIRISKMVSAVEDFTVSDWANEQMQSLEVEYKNS

SEQ ID NO: 1053 - protein, 421 aa, Triticum aestivum
  misc_feature (202)..(202): Xaa can be any naturally occurring amino acid
  misc_feature (234)..(234): Xaa can be any naturally occurring amino acid
  misc_feature (256)..(256): Xaa can be any naturally occurring amino acid
  misc_feature (279)..(279): Xaa can be any naturally occurring amino acid
  misc_feature (295)..(295): Xaa can be any naturally occurring amino acid
  misc_feature (303)..(303): Xaa can be any naturally occurring amino acid
  misc_feature (330)..(330): Xaa can be any naturally occurring amino acid
  misc_feature (338)..(338): Xaa can be any naturally occurring amino acid
  misc_feature (349)..(349): Xaa can be any naturally occurring amino acid
  misc_feature (363)..(363): Xaa can be any naturally occurring amino acid
MAATVAVDNLNPKVLKCEYAVRGEIVIHAQRLQQQLQTQPGSLPFDEILYCNIGNPQSLGQQPVTFFREVLALCDHPDLLKKEEIKTLFSADSISRAKQILALIPGRATGAYSHSQGIKGLRDAIASGIASRDGFPANADDIFLTDGASPGVHLMMQLLIRNEKDGILVPIPQYPLYSASIALHGGSLVPYYLNEPTGWGLXESLMLKKQLRRSRSKSIDVRALVVINPGNPTXGQVLAGGKQYDIVKFCKNEGLXLLADEVYQENIYAGQQEIHSFKXKIVRSLGIRRGGLPLXVSYQSVSXKGYYGECGKRVVTWEITGLSAPIKRAXYKIASVNXKFNITGQILLXSVMNHKGSDESYAXIKAEKDGILIVPSRIGNRHHELRNSSPGQGHVPFREKIPAIISRFTVFHETFMAEYRD

SEQ ID NO: 1054 - protein, 237 aa, Triticum aestivum
  misc_feature (89)..(89): Xaa can be any naturally occurring amino acid
  misc_feature (176)..(176): Xaa can be any naturally occurring amino acid
  misc_feature (211)..(211): Xaa can be any naturally occurring amino acid
MMGRKALDYEELNENVKKVQYAVRGELYLRASELQKEGKRIIFTNVGNPHALGQKPLTFPRQVVALCQAPFLLDDPNVGLIFPADAIAXRAKHYLSLAPGGLGAYSDSRGIPGVRQEVAEFIQRRDGYPSDPELIYLTDGASKGVMQMLNAIIRNERDGILVPVPQYPLYSAAISXLGGSLVPYYLEEEANWGLDLVSTRQSVAEARSKGXITVRAMVIINPGNPSGQWLREKNRDF

SEQ ID NO: 1055 - protein, 413 aa, Ralstonia solanacearum GMI1000
MKTIQKSAKLNNVCYDIRGPVLEKAKQMEEEGHQIIKLNIGNLAPFGFDAPEEIQQDMIRNLPNSAGYSDSKGIFAARKAVMHYTQQQGIKNVTLDDIYLGNGASELIALATNALLDAGDELLLPAPDYPLWTAMTSLSGGTPVHYLCDESNGWMPDLDDIRAKITPNTKGIVVINPNNPTGALYSDALLHDIIAIAREHGLVIFADEVYDKVLFDDNRHTAMASLSEDVLTVTFNSLSKSYRSCGYRAGWMVVSGDKRPAKDYIEGLNMLSSMRLCANVPGQWAIQTALGGYQSINDLVAPGGRMRRQRDLAYELITAIPGVSCVKPKAALYMFPRLDPSVYPIDDDQTFIRQLLEEERVLLVQGTGFNWHSPDHFRIVFLPHEDDLREAIGRIARFLERYRQRHGTGIRAA

SEQ ID NO: 1056 - protein, 927 aa, Vitis vinifera
MPGNKYNGISSVPTSRVERLLRDRELRKSSRASHPNEANDTNRGTEVLEHEGDNLGSSHVEQHSETAAIRGVLSEECEKQETRPARQRLLVVANRLPVSAIRRGEESWSLEISAGGLVSALLGVKEFEARWIGWAGVNVPDEAGQRALTKALAEKMCIPVFLDEDIVHQYYNGYCNNILWPLFHYLGLPQEDRLATTRSFQSQFAAYKKANQMFADVVNKHYEEGDVVWCHDYHLMFLPKCLKKYNSEMKVGWFLHTPFPSSEIHRTLPSRSELLHSVLAADLVGFHTYDYARHFVSACTRILGLEGTPEGVEDQGRLTRVAAFPIGIDSHRFIRALDAPQVQDRINELKRTFTGRKVMLGVDRLDMIKGIPQKILAFEKFLEENSEWQQKVVLLQIAVPTRTDVPEYQKLTSQVHEIVGRINGRFGTLTAVPIHHLDRSLDFYALCALYAVTDVALVTSLRDGMNLVSYEFVACQESKKGVLILSEFAGAAQSLGAGAILVNPWNITEVASSIAQALNMPPEEREKRHEHNFEHVKNHTAQEWAETFVSELNDTVVEADLRKRKVPPRLTPENAIKCYLQSNNRLLILGFNVTLTEPVDTPGSRGGDQIKEMDLKLHPELKGPLTALGNDPKTTIVVLSGSDRTVLDDNFGEFDMWLAAENGMFLRHTKGEWMTTMPEHLNMEWVDSVKHVFEYFTERTPRSQLQKRETSLVWNYKYADAEFGKLQARDMLQHLWTGPISNASVDVVQGSRSVEVRAVGVTKGAAIDRILGEIVHNKSMTSPIDYVLCAGHFLGKDEDVYTFFEPELPSDNISMAKSRAIDAFKLSGERKSSLKLPANKSGSKSSHGKTQRPLPNPDKKTPDHSSGSGSGRRPSPEKTSWNVLDLKGENYFSCAVGRTRTKARFTFGSSDEVVSFLKELAGAKSSF

SEQ ID NO: 1057 - protein, 969 aa, Musa balbisiana
MRPASGQPPDEQRGMQGSKYGGSRNPTRVERLLRDRELRKINRAFQQDEAGGNGGREAESSEHLPEDCGREVGGEPDEEIVDGSLAPVITTGQGSRRSGGRPMKQRLLVVANRLPVSAVRRGEDSWSLEISAGGLVSALLGVKDVDAKWIGWAGVSVPDEVGQRALTKALAEKRCIPVFLDEEIVHQYYNGYCNNILWPLFHYLGLPQEDRLATTRSFQSQFDAYKRANQMFADVVNQHYQEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFKRALELPAVKEHINELTHRFAGRKVMLGVDRLDMIKGIPQKILAFEKFLEENPSWRDKVVLLQIAVPTRTDVPEYQKLTSQVHEIVGRINGRFGTLTAVPIHHLVCLTTILMDRSLDFHALCALYAVTVYIFHFFSDVALVTSLRDGMNLVSYEFVACQGSKKGVLILSEVHLGKQLEKYLTIFIGAILQMGGDGKSYALNMSPDEREKRHRHNYAHVTTHTAQDWAETFVSELNDTVVEAQLRTRQVPPLLPTNIAIERYLQSMNRLLILGFNATLTESVESSGRRGGDQIKEMELKLHPELKVPLTTLCNDAQTTVVVLSGSDRSVLDDNFGEYNMWLAAENGMFLRHTGGDWMTTMPEHLNMDWVDSVKHVFEYFTERTPRSHFEHRETSLVWNYKYADVEFGRLQARDMLQHLWTGPISNTAVDVVQGSRSVEVRSVGVTKGAAIDRILGEIVHSKSMVTPIDYVLCVGHFLGKDEDIYTFFEPELPAEPASSTRMKISETSKASPDKRSTGRSSNIRNNSRMSHVRPQRAPVGSERRMPANHNILTGWRSPQETMSWREGSSVLDLKGDNYFSCAVGRKRSNARYLLNTSDDVVVFLREMAEAACQGALAALF

SEQ ID NO: 1058 - protein, 477 aa, Coprinopsis cinerea okayama7#130
MRPLTIDSLNPAILKVEYAVRGELAIKAEKYRVQLQDKDNHGLPFDRVISSNIGNPQQKGLDQPPITFNRQVAALMEYPALAELAPNAFPKDVIARAKELYAEIGSIGAYSHSQGVPFIRKSVAQFIQERDGYPADPNHIFLTAGASAGVSLLINMLISSPTSGILIPIPQYPLYTATLAQHHGVPIPYYLDESQGWGTSVDSIEAALEKAHKNNVVPKALVIINPGNPTGALLDEATQIKLVHLCEKYSLVLLADEVYQSNLHKPDQHPFTSFKKVVRKLDSHVPLVSFHSISKGVTGECGRRGGYFECVNISEPIIALMYKMVSVGLCPPLAGQIGVDCMIRPPKPGDESYELWKKETDTIHEALRTRTSIMAERLNALPGVSCVDSPGALYLYPQITLSKKAQEAARAAGKEPDAFYALELLDATGICVVPGSGFGQKENEWHYRLTCLCPGVDEYVGKLEKFHLSFIEKWGLE

SEQ ID NO: 1059 - protein, 610 aa, Lolium perenne
MLVVLGEFYTSFDQIYHQIFHFAMQFSPVQSSSPCLMACSSVCYQVQSMRINQLCNSTDIIAVNGQLPGPTIDVFEGDEVVVDVINSSPYNLTIHWHGIMQLRTPWADGPSMVTQCPIQPNSSYIYRFNVTGQEGTLWWHAHSSFLRATVYGAFIIRPRKGNAYPFPMPDQEVPIVLGEWWSQNVVDVENDAVMSGQRPIQSDAYTVNGLTGQLYQCANETFTAVVQPNTTVLLRVINAALNAHLFFKVAGHNFTVVAVDACYTANYTTDTLVLAPGNSVDALIFTDAAPGSYYMAVEPHDTLSPSTVATTDDDSTATGILLYNGTSATATPAMPTMPTNFDTTTANAFYFGLRGLPAAVPSPVDVSITIELGLGQLPCDATQTSCTGKAFAAAMNGVSFRLPTQLSLLEAQFDGKPGVYTADFPDAVPPNGTAMVEGTRVRSLPYNSTVEIVLQNPVALPSENHPIHLHGFNFFVLAQGLGTFTPGNTSAYNLVDPVARNTIAVPTGGWVVIRFLANNPGYWFFHCHLDAHVPMGLGMVFAVENGTTPDSILLPPPDDLPMCRPGSKRRHVAPPPPPPEAKAQPPQSHETNGRPPSNKEGEDITRGGAR

SEQ ID NO: 1060 - protein, 908 aa, Ulva pertusa
MTPGPITTDAAAGVGVDTMDGTMKWELFEENRTLTTRSGQMIVNDGEFGKWNDTDEGRVKCFLTPDEGFGDAIESLVIVLYRLPIIAKRDATTGAWSFKWDDDALYLTSTGLRKGLEQLKVAPLWVGILNSDDEVPRQEREGVADRLLEEFNCVPVFIPHDTLKQFYQGFCKGTLWPLFHMVSSATDHTEHTTRFDDRLWRVYMNVNRMFRDKVVEVYDGDRALIWVHDYHLMLLPQASRSRLSGVKIGFFLHIPWPSSEVYRVLPWRNELLKGMLSATLLGFHLFDYARHFLSACVRLLNLEHEANRGSLGLEYDGRHVMLRVSHIGVDPERFSEGLSAPSLTDRVAEFKERFADCTVLGAVDDLDLIKGIALKLMGFQRYLDTAPKMRGKVVLVQVAIPKAARVKAAVRNEIRELVAAINDKHGDGSGRRPVWYLEESISFESRLALYSIMDALVVTPIRDGLNLIPYEYIVSTSEGKGQLVLSEFTGCSRALSSAVRVNPWDLEKLCGVLGMVVQKAIAASPEVELKRRADKAYVSARSSQQWAQSFLHDLKEASEPAQVVVKVGPLAGLPGVLTYDEFTLLNRSAVLRAYKAAKRRLFLFDYDGTLTSITEQSSQMAHAWARPSEAVAANLDTLSKDPINDVYIMSGRKTEVLEAGLNNSPTIGIAAEHGFFYRKKNSKEWNRLLEDADLSWMELALRIMLMYTDRTDGSYVEQKKAGLVWHYLDADREFGSWQAKEMRDHLESLLSPFSVQVVTGYGWLQVRMAAMNKGVMVETILRDMPEPPDFVLCCGDDRTDEDMFAYLDTHLDPSVKQFTCTVGVKPSHARYYLHSSNEVGALLETLVTGSYPRGVRPRPRGGSVSLADLVPDDEGSSSTPAVPQRTNGPRTSASGQKRRGLASSLPSQ

SEQ ID NO: 1061 - protein, 908 aa, Ulva prolifera
MTPGPITTDAAAGVGVDTTDGTMKWELFEENRTLTTRSGQMIVNDGEFGKWNDTDEGRVKCFLTPDEGFGDAIESLVIVLYRLPIIAKRDATTGAWSFKWDDDALYLTSTGLRKGLEQLKVAPLWVGILNSDDEVPRQEREGVADRLLEEFNCVPVFIPHDTLKQFYQGFCKGTLWPLFHMVSSATDHTEHTTRFDDRLWRVYMNVNRMFRDKVVEVYDGDRALIWVHDYHLMLLPQASRSRLSGVKIGFFLHIPWPSSEVYRVLPWRNELLKGMLSATLLGFHLFDYARHFLSACVRLLNLEHEANRGSLGLEYDGRHVMLRVSHIGVDPERFSEGLSAPSLTDRVAEFKERFADCTVLGAVDDLDLIKGIALKLMGFQRYLDSAPKMRGKVVLVQVAIPKAARVKESVRNEIRELVAAINNKHGDGSGRRPVWYLEESISFESRLALYSIMDALVVTPIRDGLNLIPYEYIVSTSEGKGQLILSEFTGCSRALSSAERVNPWDLEKLSNVLDMVVQKAIAAAPEVELKRRADKAYVSAHSSQQWAQSFLHDLKEASEPAQVVVKVGPLAGLPGVLAYDEFTLLNRSAVLRAYKAAKRRLFLFDYDGTLTSITDQSSQMAHAWARPSEAVAANLDTLSKDPLNDVYIMSGRKTEVLEAGLNNSPTIGIAAEHGFFYRKKNSKEWNRLLEDADLSWMELALRIMLMYTDRTDGPYVEQKKAGLVWHYLDADREFGSWQAKEMRDHLESLLSPFSVQVVTGYGWLQVRMAAMNKGVMVETILRDMPEPPDFVLCCGDDRTDEDMFAYLDTHLDPSVKQFTCTVGVKPSHARYYLHSSNEVGALLETLVTGSYPRGVRPRPRGGSVSLADLVPDDEGSSSTPAVPQRTNGPRTSASGQKRRGLASSLPSQ

SEQ ID NO: 1062 - protein, 336 aa, Nicotiana tabacum
PRRAAEDCFPPLDYRQQRPSQELVAKDLHGIEWKFRHIYRGQPRRHLLTTGWSAFVNRKKLVSGDAVLFLRTADGELRLGVRRAAQAKTCSNYLAAYSQLLNVSGIVDVVKAISSTNAFSICYNPRASSSGFILPYHKFSKTLAHPFSAGMRFKMRVETEDAAEQRFTGLVVGVSDVDPVRWPGSKWRCLLVRWDDLDVSRHNRVSPWEIEPSGSAPVSSSLVMPSAKRTRVGFPITKADFPIPRDGIAVSDFGESSRFQKVLQGQEILGISSPFVGFDAHSPRTAGIRCFPGFPSSGASRLGNSIRTLLGDTDKSPESIGFSDSSRFNKVLQGQE

SEQ ID NO: 1063 - protein, 670 aa, Cryptococcus neoformans var. grubii
MTTMSNDIPNSPTSTSFTGTFSPAATAANTAANARTSDAPSPTTSSSGPKLETSKEQRLIVVSNRLPVTISKDDNGEYHFKMSSGGLVSALSGCKKTMSFTWIGWPGKDIPMQDRETVNRRLLDEYNCYPVYLSDELADSHYNGSFSNSILWPLFHYHPGEMNFDAAHWLAYREANMRFADVVSSLVQAGDMVWVQDYHLMLLPMLLRSMITGESAQGEMVRQELGRVKEGVDDTVVKEVLKMGPGVAQAEDEGVEMLDDVEEEGGEMDVKSSPKRPHYARGMSTFQKQELVAKEKGKEGIRIGFFLHTPFPSSEIYRILPVRREILLGVLQCDLIGFHTYDYARHFLSSCTRILGLETQPNGIEFDGRYCQVGTFPIGIDPNQFIEGLQKESIVKRLRSLEARFEGVKVIIGVDRLDYIKGIPQKLQALETFLTQHPEWIGKVVLVQLAIPSRQDVEEYQDLRACVNELVGRINGRFGTVESVPIHYMHKSVPFEELTAMYALADACLVTSTRDGMNLVAYEYISSQAERHGSMILSEFAGAAQSFNGSLLINPWDVQSTADAINQALTLSPQQRKTNWQKLFNYVSKYTAEAWGVSFVNELNRLSGQRPSGPTGLAGRRKSGSLSRTSSKASIQRRKSSQSGIVTGLGAAAGAAVNWAQAQVQGGSQT

SEQ ID NO: 1064 - protein, 336 aa, Nicotiana tabacum
PRRAAEDCFPPLDYRQQRPSQELVAKDLHGIEWKFRHIYRGQPRRHLLTTGWSAFVNKKKLVSGDAVLFLRTADGELRLGVRRAAQAKTCSNYLAAYSQLLNVSGIVDVVNAISSTNAFSICYNPRASSSGFIIPYHKFSKTLAHPFSAGMRFKMRVETEDAAEQRFTGLVVGVSDVDPVRWPGSKWRCLLVRWDDLDVSRHNRVSPWEIEPSGSAPVSSSLVMPSAKRTRVGFPITKADFPIPRDGIAVSDFGESSRFQKVLQGQEILGINSPYGGFDAHSPRTAGIRCFPGFPSSGASRLGNSIRTLLGDTDKSPESIGFSDSSRFNKVLQGQE

SEQ ID NO: 1065 - protein, 175 aa, Pseudoalteromonas tunicata D2
MASVGIFFGSDTGNTEHVAKQIQKELGKKLVDVFDIAKSSKEQIAEFDLLLFGIPTWYYGEAQCDWDDFFPELEEIDFDGKLAAIFGCGDQEDYSEYFLDAMGMVRDIVEKKGGVIIGNWPTASYNFEASKALVDNDHFVGLGIDEDRQPELTEQRIKQWCKQVYEEMCLAELED

SEQ ID NO: 1066 - protein, 570 aa, Aspergillus nidulans FGSC A4
MAQLWGWISVYCLLILSFTVRSLGQEQSAFCEHSSLARECWGQYNISTDYHAITPDTGVTREYWLVAENTTLAPDGYERQVLVFNGTLPGPLIEANWGDELVIHVTNGLEHNGTAIHWHGIWQRGTNQYDGVPGVTQCPISPGQTYTYRFRATQYGTTWYHSHFSLQLAEGLFGPLVIHGPASADYDVDLGSVFISDWYHKSAFILWEESTRYGGVPVRANAVPPTGLFNGSNVFGGGGRRSEMIVEKGKKYRLRLIDSSVDGWMKFSIDGHKLTVISADLVPIEPYETDAVILTSGQRYDVVFEANQKIGNYWTRVIYQTACNGLDIKDPDIRGILRYAGAEISDPTSSQWSSIRNSCGDEPYDKLVPYVKRTVGKAAGQENLNVGWYYDLPELYFHWTLNTKALTIDWGTPTNKLIYNNESVFPTEYNIYEVPNRDQWTYWVIQDVGLVNAYHPFHLHGHDFFILAQGRGLYTPLVKLNRDNPPRRDTATMAGNGFLVIAFESDNPGSWLMHCHIAWHASQSLALQFVERESEIGPLIEPVIGEIESDCKKWEKYHAESVYHQDDSGI

SEQ ID NO: 1067 - protein, 423 aa, Corynebacterium diphtheriae NCTC 13129
MNNKKETPQAAPAQRKRTRRIFDQSDKLKNVLYEIRGPVTAEAEAMELDGHRILKLNTGNPAIFGFEAPDVIMRDMIASLPTSQGYSTSKGIIPARRAIVTRYEVIPGFPAFDVDDVYIGNGVSELITMTTQALLNNGDEVLIPMPDYPLWTAATSLAGGKPVHYLCDEEDDWNPSIEDIKSKITERTKAIVVINPNNPTGAVYSKEVLQKIVDVAREHDLLILADEIYDRILYDGAVHTNIAALAPDLLCITFNGLSKAYRVAGYRAGWMIVTGPKNNARGFIEGLDLLSGTRLCANVPGQHAIQVALGGRQSIYDLTGQGGRLLEQRNVTWEKLNAIPGVSCVKPMGALYAFPKLDLEYYDIKDDAQLMLDLLRQEKILMVQGTGFNWDKPDHFRVVTLPWASQLSEAMDRLGNFLASYKQ

SEQ ID NO: 1068 - protein, 653 aa, Yarrowia lipolytica CLIB122
MKFQVVTAALALAGLCSAQLAPIGKNDKYYNFTATWVNANPDGVHERRVIGINDQWPIPTINVTKGDRVIVDLYNDLGTQNVSLHWHGLFMEGQNAQDGPVWITQCPQSPEDSSFAFRYNFTVEQAGTYWYHSHVGGQYPDGLRGVFIVNDPEDPYKDEYDEHIWFTVSDWYHEEIPDLLPDFLSVYNPTGAEPIPSNILFNDTLNTTIKVEPGKTYKLSIINIGAFVSQYVEIMNHTMEVIEIDGVYTEKSDPIDLLYITSAQRYSVLLKTKDDASTNFPIMTTIDGTMLDLTPEDLVLYQTNWLQYNDDPNDRPEGPENYYWHTDKEGDGADDEFEERRFDDMDLVPLDGMKLLPDPDMTITVNVTMNNLNNGINYAFFNELTWVAPKVPVLYTVMSSPDGMETDATIYGDNTHTYVLKHNDVIDIVLNNEDAGTHPFHMHGRVFQVPYRSEAYEDDDMTPFDPEDEDIKFAEVPMRRDTVYVKPNGNMVMRFRADNPGVWFFHCHIEWHMEQGLAFTLVEAPEELKKQYVPPNHFDACKIAEVPTVGNAAGNDTDFLNLSGQNLQEKDLPAGFTARGIVALVFSCIAAFLGMGAVAWYGASDIKNQEIRMIQEFEREAGEEVDGAESLQDVQDEPVHIPHPHLHHNNATN

SEQ ID NO: 1069 - protein, 498 aa, Lentinus tigrinus
AVGPVADLTVTNANIVPDGFERAAIVVNNVFPAPLITGNMGDNFQLNLVNQMTNHTMLKTTSIHWHGFFQKGTNWADGPAFINQCPIASGNSFLYDFQVPGQAGTFWYHSHLSTQYCDGLRGPFVVYDPNDPHANLYDVDDESTVITLADWYHVAAKLGPRFPKGADSTLINGLGRSTSTPTADLAVISVTKGKRYRFRLVSLSCDPNYTFSIDSHQLTVIEADGVSTQPVTVDSIQIFAAQRYSFVLNANQDVDNYWIRANPNFGTTGFADGVNSAILRYDDADPVEPVTNQTGTTLLLETDLHPLTSMPVPGNPTQGGADLNLNMAFNFDGTNFFINGESFTPPTVPVLLQIISGANTAQDLLPSGSVYSLPSNSSIEITFPATTAAPGAPHPFHLHGHVFAVVRSAGSTSYNYDDPVWRDVVSTGTPQAGDNVTIRFQTDNPGPWFLHCHIDFHLDAGFAVVMAEDIPNTVNANPVPQAWSNLCPTYDALEPSNE

SEQ ID NO: 1070 - protein, 97 aa, Arabidopsis thaliana
  misc_feature (13)..(13): Xaa can be any naturally occurring amino acid
MAVKALDYHTLNXENDKKCQEAGRGELYHRASGLKNEGNRIILTNVGNPDASRQMPLTLNRQVGALCQASFLLEDPNVGMLFPADAIARAEHYLFLT

SEQ ID NO: 1071 - protein, 504 aa, Aspergillus nidulans FGSC A4
MPGVEKSSQNESRLLLVSNRLPITIKRSEDGKYDFSMSSGGLVSGLSGLSKTTTFQWYGWPGLEVPEEEIPTLKNRLKEEYNAIPVFIDDELADRHYNGFSNSILWPLFHYHPGEITFDESAWEAYKEANRLFAQAVASQVQDGDLIWVHDYHLMLLPEMLREEIGNTKKNIKIGFFLHTPFPSSEIYRILPVRNELLLGLLHCDLIGFHTYDYTRHFLSACSRLLGLPTTPNGIEFQGKIIACGAFPIGIDPEKFKEGLKKEKVQKRIATLEQKFQGVKLMVGVDRLDYIKGVPQKLHALEVFLSDHPEWVGKVVLVQVAVPSRQDVEEYQNLRAVVNELVGRINGKFGTVEFMPIHFLHKSVNFDELIALYAVSDACVVSSTRDGMNLVSYEYIATQEKRHGSLVLSEFAGAAQSLNGSIIVNPWNTEELAAAYHEAVTMSDEQRALNFSKLDKYVNKYTSAFWGQSFVTELTRISEQAAGKLPTKETPVNGETSKLETSSQ

SEQ ID NO: 1072 - protein, 468 aa, Burkholderia vietnamiensis G4
MSRLVVVSNRIADPRKAAAGGLAVAVKDSLQESGGVWFGWSGRLRSEGERPAQGDDVQIQNVGGIQLATIDLDPQDYDAYYLGYSNNVLWPVFHYRLDLAQFDRRFADGYRRVNQLFARKLSTLLRPDDTIWVHDYQLIPLAAELRAMGCTNPIGFFLHIPMPPPPIMAAIPEHEWLMRALFAYDLIGFQTESDLLHFEHYVEAEAGAARLPDGRLRAFGRTLSAGAFPIGINVDEFAALAENRDGIDMFERMRDEYSRRQLLVGVDRLDYTKGLPQRVHAFRQLLEQYPENRDRATLIQIAAPSREDLGAYDDLRREMDSLCGAINGDYGELEWMPMRYIHRTVARKRLPGLYRASRVALVTPLRDGMNLVAKEFLAAQDEADPGVLVLSRFAGAAEQLKPALLVNPYDTQGTAQAIQRALTMPLDERRQRHNALMAIVRKTDVHWWRTRFLDALTEAAEVAAAAAS

SEQ ID NO: 1073 - protein, 857 aa, Gossypioides kirkii
MMSRSYTNLLDLASGNFPAMGQPREKKRLPRVMTVPGVISELDDDQANSVTSDAPSSAIQDRIIIVANQLPVKAKRRPDNKGWSFSWDDDSLLLQLKDGLPEEMEVLYVGSLTVDVDPVEQDDVSQLLLDKFKCVPAFLPPDILTKFYHGFCKQHLWPLFHYMLPFSASHGGRFDRSLWEAYVTANKIFSQRVIEVINPEDDYVWIHDYHLMVLPTFLRRRFNRLRMGFFLHSPFPSSEIYRTLPVREEIMKALLNSDLIGFHTYDYARHFLSCCSRMLGLEYQSKRGYIGVEYYGRTIGIKIMPVGIHMGQIKSVLSLADKEWRVAELKQQFEGKTVLLGVDDMDVFKGIDLKLLAMEQMLKQHPKWQGRAVLVQIANPSRGRGKDLEDIQAEIQASCKRINETFGQPGYEPIVLIDRPVSLCERFAYYTIAECVVVTAVRDGMNLTPYEYIVGRQGVSESESSSESSGPKKSMLVVSEFIGCSPSLSGAIRVNPWNTESTAEAMNEAISMADAEKQLRHEKHYRYVSSHDVAFWSRSFFQDMERTCKDHFRRRCWGIGLSFGFRVVALDPNFRKLSIDHIVSVYLRCKNRAILLDYDGTVMPQTSHNKTPSAEVISIINALSGDTKNTVFVVSGRGRESLGKWFSPCKKLGIAAEHGYFMRWSANDEWELCGQNSEFGWKQIAEPVMKLYTESTDGSSIETKESALVWHHRDADPGFGSSQAKEMLDHLESVLANEPVAVKSGQFIVEVKPQGVSKGMVAEKIFTTMSEKGKQADFVLCIGDDRSDEEMFEIISSAISSGILSSSTSVFACTVGQKPSKARYYLDDPAEVLNMLEALAEASDPESFTDTESEGSL

SEQ ID NO: 1074 - protein, 429 aa, Methylobacillus flagellatus
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLSRQCARAVGDPDRAGRYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEAKPRKRAQTTSQSASA

SEQ ID NO: 1075 - protein, 172 aa, Vibrio vulnificus CMCP6
MKIGLFYGSTTCYTEMAAEKMRAILGDDLVEIHNVKECDLAQMADYDLLLLGISTWDFGEIQEDWAAIWHDLASSPVQGKTIALFGLGDQEGYGEWYLDAMGLLHDELKAVGAEFIGYWPNQGYQFEASKALTEDGSHFVGLALDEDSQYELSDERIETWIEQVLTEFHDKL

SEQ ID NO: 1076 - protein, 517 aa, basidiomycete PM1
MAKFQSLLTFITLSLVASVYASIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGPAVPTADATLINGLGRSINTLNADLAVITVTKGKRYRFRLVSLSCDPNHTFSIDGHSLTVIEADSVNLKPQTVDSIQIFAAQRYSFVLNADQDVDNYWIRALPNSGTRNFDGGVNSAILRYDGAAPVEPTTTQTPSTQPLVESALTTLEGTAAPGNPTPGGVDLALNMAFGFAGGRFTINGASFTPPTVPVLLQILSGAQSAQDLLPSGSVYSLPANADIEISLPATSAAPGFPHPFHLHGHTFAVVRSAGSSTYNYANPVYRDVVSTGSPGDNVTIRFRTDNPGPWFLHCHIDFHLEAGFAVVMAEDIPDVAATNPVPQAWSDLCPTYDALSPDDQ

SEQ ID NO: 1077 - protein, 164 aa, Saccharomyces cerevisiae
AWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVG

SEQ ID NO: 1078 - protein, 481 aa, Populus euphratica
MVFKLNSHLLSRIASSDGHGEDSPYFDGWKAYDSDPHHPTDNPNGVIQMGLAENQLCFDLIQDWLKKNPKASICSPEGLNEFREIAIFQDYHGLPEFRNAVANFMEKVRGNRVTFDPDRIVMSGGATGAHETIAFCLADPGEAFLVPTPYYPGFDRDLRWRTGVKLIPVDSDSSNNFMVTREALENAYEKAQLDNIKVKGLLITNPSNPLGTILDRETLRSIVRFINEKNIHLVCDEIYAATVFSQPDFISVRRILQEDIECNLDLVHIVYSLSKDMGFPGLRVGIIYSYNDAVVSCARKMSSFGLVSTQTQYLIASMLSDNEFVEMFIRESKRRLAARYRVFTRGLDQVGIECLKTSNAGLFLWMDLSRLLKQQTFKAEMELWRVIIHEVKLNVSPGCSFHCLKPGWFRVCFANMDDETMQVALSRIKTFVNKEADTKKSRKNLRWQGSLKLLNSPRIYDDFINSPHSPIPQSPLVRARN

SEQ ID NO: 1079 - protein, 171 aa, Triticum aestivum
MHLWQLAHSKVGVAQVLLHLTLLLEPSHEELQSWVHPLHCICAAACNGEEDSTTSTSMAAIATTLTEAIVVSYMLALMDGVLDLKPVHEAQICLPQKAIEAAKAANKAPDAFYALRLLESTGIVVVPGSGFGQVPGTWHFRCTILPQEEKIPAIISRFTVFHETFMAEYRD

SEQ ID NO: 1080 - protein, 186 aa, Oryza sativa
  misc_feature (4)..(4): Xaa can be any naturally occurring amino acid
  misc_feature (24)..(24): Xaa can be any naturally occurring amino acid
  misc_feature (33)..(33): Xaa can be any naturally occurring amino acid
  misc_feature (41)..(41): Xaa can be any naturally occurring amino acid
MVNXGKRGRLTWRFTGFQWLPVRXAQIYKVASXVNLCSNIXTGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 1081 - protein, 404 aa, Streptococcus pyogenes str. Manfredo
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 1082 - protein, 486 aa, Populus x canadensis
MERQHQLLSKIATNDRHGENSPYFDGWKAYDKNPFHPTDNPDGVIQMGLAENQLSADSIIDWIKKHPKASICNPEGVHMFKDIANFQDYHGLPEFRQAIAKFMGRVRGGRVTFDPDRIVMSGGATGANELIMFCLADPGDAFLVPSPYYPAFYRDLGWRTGVQIVPVDCDSSNNFQITKVALEAAYDKAQQDGINVKGLIITNPSNPLGTTLDRETLKCLLSFINEKNIHIVCDEIYAATIFSSQNFVSVSEVIEEVMDCNRDLIHIVYSLSKDMGLPGFRVGIVYSYNDAVVNCGRKMSSFGLVSSQTQYLLASMLSDEEFVEDFLAESSKRLKKRHGIFTKGLEQIGISCLESKAGLFVWMNLRHLLKEQTNDGEMELWRVIVNDVKLNVSPGSSFHCVEPGWFRVCFANMDDETLEVALKRIHAFVGEQKERETLSTKTKDMPSKTKCWKKNLRLSFSSRIFEEGIGSPIAMSPHSPLVRART

SEQ ID NO: 1083 - protein, 515 aa, Coprinopsis cinerea okayama7#130
MVISNANVSPDGVPRSAVVVNGVHPGPVLVGQKDDNFAINVVNELTDPTMLRSTSVHWHGLFQRGTNWADGAEGVNQCPIAPERSFLYRFSPAGHAGTFWYHSHFGTQYCDGLRGPMVVYDPEDPYKDEYDVDDVNTIITLADWYHTPAPSIRGAFRPDATLINGLGRTPGGPPVDLAVVNVQEGQKYRFRIVSLACDVNFQFSIDGHKLTVIEADGQLTDPLEVDRIQIFTGQRYSVILHANQAPNNYRIRAIPNAGVAGLTGTVDGGVNSAILRYAGAPVAEPTTEAPSNMIDLSESQLHAYAGGDPAAPGRPEAGGADVTIPLRFTFSGGRFFVNGTSYTSPSVPTLLQIMNGANPGELLPENSVYYLPRNQVVEVEIPSTGISGSGPHPFHLHGHAFSVVRSAGNSSYNYVNPVKRDVVSMGGDSDLVTIRFVTDNPGPWFFHCHIEPHLVGGLAIVFAEAMEDTAAAHPDIPTEWRDLCDIHHDLDPSLTSVSIVRRAEPTGLSAKFRGL

SEQ ID NO: 1084 - protein, 523 aa, Botryotinia fuckeliana
MPSVAGEEPKASSRLLLVSNRLPITIKRTEDGQYDFTGSSGGLVTGLSGLAKTTTFQWYGWPGLEVPDAEAKPLVKRLKDEHGAHPVFVDDELADKHYNGFSNSILWPLFHYHPGEITFDESQWMAYKEVNRLFAKTIAKDVQDGDLIWVHDYHLMLLPEMLRDEIGTSKKNVKIGFFLHTPFPSSEIYRILPVRESLLLSVLHCDLIGFHTYDYARHFLSSCSRILETQTTPNGVEFRGKYVTVAAFPIGIDPEKFIETLKKPKVEERIAQLERKFEGVKLIVGVDRLDYIKGVPQKLHALEVFLTEHPEWIGKVVLVQVAVPSRQDVEEYQNLRAVVNELVGRINGRFGTVEFMPIHFLHQSVNFDELTALYAVSDACLVSSTRDGMNLVSYEYIATQRKRHGVMILSEFTGAAQSLNGALIVNPWNTEELADAIHDAVTMSPEQREINFKKLEKYVFKYTSSWWGESFVSELQRISEHAAKKSNSKGTVDKMPDLVEGVQQFNLGEQREEGRLEPGEFDD

SEQ ID NO: 1085 - protein, 528 aa, Trametes sp. C30
MSKFQSLAAFIALSLSTGRLAAAAIGPKADLTISNANISPDGFTRAAVVANNQFPGPLITGNKGDNFQINVIDNLSNDTMLTSTTIHWHGFFQKGTNWADGPAFVNQCPISEGNSFLYDFSAADQAGTFWYHSHLSTQYCDGLRGVMVVYDPNDPHQSLYDVDDESTVITLSDWYHTAARLGPRFPLGADTVLINGLGRFATGDPDAELAVITVTKGKRYRFRLANISCDPNFTFSIQGHTMNVIEVDSVNVTPYEVDSIQTFAGQRYSFVLTADQDVDNYWMWAIPNVGTINTDGGVNSAILRYDGAAEIEPEAASPSVNNQLVESNVVPLTDVAAPGNPTVGGVDYALNLDFSFDGTNFAINGESYTSPSVPVLLQILSGAQTAPDLLPNGSVYVLPSNATVELSFPMTATNAPGAPHPFHLHGHTFYVVRSAGQTDYNYVNPPQRDTVSVGAAGDNVTIRFRTDNPGPWFLHCHIDFHLEAGFAVVFAEDTPNVASVNKPSAAWEDLCPTYNSVYPNGDSGDARR

SEQ ID NO: 1086 - protein, 503 aa, Mycobacterium abscessus
MATQSDERSPVKPVTGTSDFVVVANRLPIDLVKLPDGSTTWKRSPGGLVTAMEPLLRKRRGAWVGWPGVPDADVEPVSEDDMVLYSVRLSTQEVAEYYEGFSNATLWPLYHDVIVKPEYHREWWQAYVDVNRKFAEATAAVAAEGATVWVQDYQLQLVPKMLRMLRPDLTIGFFLHIPFPPVELFMQMPWRTEIVDGLLGADLIGFHLAGGAQNFMYLARRLVGASTSRASIGVRSRFGEIRVGFRTVKVGAFPISIDSTQLDSVSRSRQIRQRAKEIRAELGGPRKILLGVDRLDYTKGIDIRLHAYEELLAEGRASREDTVFVQLATPSRERVDSYKKMRGDVEQQVGHINGEFGEVGHPVVHYLHRPVPREDLIAFFVAADVMLVTPLRDGMNLVAKEYVACRSDLGGSLVLSEFTGAAAELRQAYLVNPHDIDGVKDGIESALNQTPEEGRRRMRALRRQVLAHDVDRWARAFLEALSTPATGDSIAPEQPAVLGGEPL

SEQ ID NO: 1087 - protein, 169 aa, Cyanothece sp. PCC 7424
MAKIGLFFGTQTGNTETIAEMIQKEFGGDGVIDLHDISGASAEDFTNYDYVIIGCPTWNVGELQSDWEGFYDELDQIDFTGKKVAYFGAGDQVGYADNFQDAMGILEEKISSLGGKTVGYWPADDYDFNESKAFKNGKFIGLAIDEDNQGDLTKSRVKTWTTQLKSEFL

SEQ ID NO: 1088 - protein, 539 aa, Coprinopsis cinerea okayama7#130
MFKNLLSFALLAISVANAQIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVIYDDNDPHAALYDEDDENTIITLADWYHIPAPSIQGAAQPDATLINGKGRYVGGPAAELSIVNVEQGKKYRMRLISLSCDPNWQFSIDGHELTIIEVDGQLTEPHTVDRLQIFTGQRYSFVLDANQPVDNYWIRAQPNKGRNGLAGTFANGVNSAILRYAGAANADPTTSANPNPAQLNEADLHALIDPAAPGIPTPGAADVNLRFQLGFSGGRFTINGTAYESPSVPTLLQIMSGAQSANDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTVVRRAEPTGFSAKFRREGL

SEQ ID NO: 1089 - protein, 907 aa, Populus trichocarpa
MRLSSSSSSTGFNQQTPEGDKKCLNSELWHACAGPLVSLPHVGSRVVYFPQGHSEQVAASTNKEVDAHIPNYPSLPPQLICQLHNVTMHADVETDEVYAQMTLQPLSQDDQKDAYLLPAELGTASKQPTNYFCKTLTASDTSTHGGFSVPRRAAEKVFPTLDYSQTPPAQELIARDLHDNEWKFRHIFRGQPKRHLLTTGWSVFVSAKRLVAGDSVLFIWNEKNQLLLGIRRANRPQTFMPSSVLSSDSMHIGLLAAAAHAAATNSRFTIFYNPRASPSEFVIPLVKYIKAVYHTRVSVGMRFRMLFETEESSVRRYMGTITGISDLDPVRWPNSHWRSVKVGWDESTAGERQPRVSLWEIEPLTTFPMYPSAFPMRLKRPWPSGLPSFHGLQDGDLNINSPMMWLQGGVGDLGVQSLNFQSFGVAPWIQPRFDTSMPALQPEMYQTMAAAALQEMRTVESSKLASQSHLQFQQSQNVSNGPAALIQRQMLQQSNLQHALLQNFQENQASTQAQFLQQHLQHRNQYTGQQLQQHQPQLQQVQQPKQLNELSAPQQIPNVISALPHLTSVAPSQSPSLQPISSQCQQQAFSEPLGNSIAASDVSSMHSVIGSLSQDGGSHLLNSNGSNPVISPALLSKRAAIDPQLSSGAAHCALPQVEQLRTTQSTVSDLATLLAPFSGREYSTYQGANDPQNNLLFGVNIDSSTFMLQHGIPNLRNIGTENDPLSMPFAASTFTSATGSDIPLNSDMTASSCVDESGFLQSSENVDQVNPSTRTFVKVHKSGSYGRSLDISKFSSYDELRSELARLFCLEGLLEDPQRSGWQLVFGDRENDVLLLGDDPWQEFVNNVWYIKILSPLEVQQMGKEGLSPAASVPCQKLSNSNSDGHMNTQGFRNSSNGIASMGSLDY

SEQ ID NO: 1090 - protein, 614 aa, Cryptococcus bacillisporus
MRGIVNFFFLSCSLILLVSSENTGKLPTATIDPSVFALSNDFEVSDVPTTREYTFDITKALASPDGYEREVYTVNNMFPGPVIEANTGDTIIVHVNNHLDKGQSIHWHGMRQKDTPYMDGVPGITQCPIPPGGSYTYNFTISDQSGTYWWHSHYSNAMADGLWGPLIVHSVHEPIQRGRDYDEDRIVFVSDWLHDDSEIIIAALATPAGYRGSPAPPQGDSILINGRGQTNCTATNSSSCYYPAPPEIHVPVNSRVRLRFISATAHPMYRISLDNHPLEIVETDGTAVYGPTVHEMSIAPGERYSAIINTSEGKEGDAFWLRTSVALGCMFGGVPQVGLAVVRYTGNEMTTTAEPQSYAWSDLANATALCAGLDQTYTLSPRERESCRVSRASSQSHIFNSQRGAFVNYLGNTFQGYGFNNISYQNKIFDPILSMVQRGDPYESTLVASTTFPDMGAGAIIINNLDGPIDHPYHLHGNEFQVIGRGTGALSLDNLTNIEFSLDNPVRKDTLWIQGGSWAALSITTDNPGVWALHCHIGWHLTEGKLAVVVVQPNAVGQIACPESWTNLCANTDPNAFGPARRSPSPSIQSSKTSAFQRLREVKGNVKRRGAREV

SEQ ID NO: 1091 - protein, 174 aa, Prochlorococcus marinus str. MIT 9312
MTVGIYYATTTGKTEDVADRLHNFISSAEAPKDVSDVDDLSEFEGLDGIICGIPTWNTGADEERSGTAWDSILEDIGELSLSGKKVAIFGLGDSSTYTENYCDAMEELHSYFAKAGAEMVGYVDKSSYTFDESKSIIGESFCGLPLDEDSESDLTDTRLETWASQLKDEIPSLA

SEQ ID NO: 1092 - protein, 97 aa, Arabidopsis thaliana
ALVIINPGNPTGQGVTEYKRGEIWGGCYNEKLALTGDEVYQQSIYQDQRTFISSKNGMMEMGAPCSMEAQLGSLHTGSKRYSGECGQRCGYFEMTNL

SEQ ID NO: 1093 - protein, 570 aa, Liriodendron tulipifera
MGALLFALNSLLLFSELAFATHTGSTWHYKFDVQLKSVKRLCNRKSILTVNGRFPGPKLVAREGDRVVVEVVNNVQNNVTVHWHGIRQLQNGWADGPSYITQCPIQTGQTYVYNFTIVGQRGTLFWHAHFSWLRATLYGPLIVLPMQNATYPFGKPDKEVPIIFGEWWNANTEAVINQSLQTGAGPNVSDAYTINGMPGPLYNCSAKDTFKLKVKPGKTYLLRLINAALNDELFFGIASHTITVVEVDATYVKPFNMKILLIGPGQTTNVLLKAKPYYPNATFFMSARPYATGLGTFDNTTTVGLLEYQRPNSSLSSTKLQIFKASLPALNDTAYAAKYSQRLRSLANAQFPANVPQTVDKHFFFTIGLSADPCPKNQTCQGPNGTKFSASMNNISFVLPTTALLQAHFFGQSNGVYNTTFPNNPLFPFNYTGTPPNNTFVSHGTKVVVIPFNTSVEVVLQNTSILGMESHLLHLHGYNFFVVGQGFGNFDPDKDPAKFNLVDPIERNTVGVPSGGWAAIRFRADNPGVWFMHCHFDVHLSWGLKMAWVVLDGKLPNQKLLPPPSDLPKC

SEQ ID NO: 1094 - protein, 989 aa, Cryptococcus neoformans var. neoformans JEC21
MDSMHPDPTPDIPPSLPDLKAQVARLEASHKEKGLPLSGRIIHVMHHLPVEIVRIVPADALESAGSGFLSPPMTPEFKPEDAETTVESADAKWRIHARTAHPALVSGIKSLSETHDQLLVAWTGEVLIQPDNTQSPQQPSQATFSSIASNLLAPFSGGAGDATPQPQPPPQQGSLMVFGGEFNEADQKEIASELDRFAEAESKFDPTDKLKYVPVFLPPDVSKGHYEGFCKKTLWPLFHYLLWLDSTATVPSPDPSWLAYQKTNQMFAQRVAQIYKPGDLIICHDYHLLLAPKMIRESLGQVFHPNAGWGTAHPSPSLHHAQRKGFDWESNQQTPTPEKAKGEKIGAFMNHVGTALGNHLGTMEHGLQNEIMIGMFMHTPWPSSEIFRCLPKRREILDGMLGANLVSFQTYSYSRHFVSTCIRVCGYESTPGGVDANGQVTAVGYCPIGIDIKRVVHDRAQPGVLPKMQALRDLYKDKKIIVGREKLDVAKGVYNKLQAFEKFLQVYPEWRGKVVLIQVTTPALSESPKLERMTAELVSHINGTYGSLDFTPVHHYHQALEKDEYFGLLSCADLALITSLRDGMNTTSMEFILCQDKTSKSPLVLSEFMGTAPSFASALQINPHDLLGVAQAINKGLTMREEEKAERHANLLEGVLAHTSHTWAATILKQLLENVGGEHTAHHTPALDTAQFADAYKKANKRLLLFDYDGTLTPIVKVPAHAVPTERTRNAIAALCKDPKNIVYLISGRDGDFLEEHWGHLDRLGLSAEHGSFVKQPGEEDFINMTEALDMSWMSEVEEIFKYYTERTTGSTIEVKKASITWHYRNSDPDFGEFQCKQALDLLESSLAPRRPIEVLVGKKNLEVRPLAVNKGEIVRRLMYENPDVDLIFCAGDDKTDEDMFRALRTVFPPGGVVDNNPVVMKPPVAVTSALEPEEVAELPDVELSIRTKGVFATTVGPPAKRTLAGWHVTCPEEVVEALESLLEEIQVV

SEQ ID NO: 1095 - protein, 585 aa, Liriodendron tulipifera
MVPLLQTSGPMAALLLALSTMLLFPEIARANQEGITRHYKFDIRLQNVTRLCHTKSIVTVNGQFPGPKIVAREGDRVVVKVVNHVQNNITLHWHGVRQLRSGWADGPAYVTQCPIQTGQTYVYNFTIIGQTGTLFWHAHISWLRSTLYGPIVILPKRGIPYPFIKPYKEVSIIFGEWFNVDTEAIITQALQTGGGPNVSDAYTINGLPGPLYNCSARDTFRLSVKPGKTYLLRLINAALNDELFFSIANHTLTIVDVDAVYVKPFDTNILLITPGQTTNVLIKTKPHYPNATFFMGARPYATGLGTFDNSTTVGLLEYQKPNSSHSSNAVGMKQLPLFRPSLPSLNDTAFAANYTKRLRSLANAQFPANVPQTINKSFFFTVGLGSEPCPKNQTCQGPNGTKFAASVNNVSFVMPTTALLQGHFFGQSNGVYTANFPTNPQFPFNYTGTPPNNTMVSNGTKVVVLPFNASVELVMQDTSILGAESHPLHLHGFNFFVVGQGFGNYNPNKDPSNFNLVDPVERNTVGVPSGSWVAIRFQADNPGVWFMHCHLEVHTSWGLKMAWVVLDGKLPNQKLPPPPSDLPKC

SEQ ID NO: 1096 - protein, 480 aa, Physcomitrella patens subsp. patens
MASGKVMDPENLNLNVKKTVYAVRGELYLRASELQKEGKKIIFTNVGNPHALGQKPLTFPRQVMALCQAPFLMDDPHVGLLFPEDAIARAKHYLAMTSGGVGAYSDSRGLPGVRQEVAEFILERDGYPSDVENIFLTDGASKGVAQVLNALIRNEKDGVLVPIPQYPLYSATIQLLGGTLVPYYLTEEDNWGMDIKGLEKSVNEARRKGITPRGLVFINPGNPTGQCLSEKNLRGLIEFCIRERVVLMADEVYQQNVYQDERPFISARKVLMGMGPRYSSALELVSFHTVSKGFLGECGQRGGYFEMTNFHPKTVEELYKVASIALSPNVTGQIMMGLMVKPPRPGDVSFPLYAAESAAIMQSLRKRAHIMTDGFNACENVVCNFTEGAMYSFPQVKLPKAAIAAARQAGKAPDVFYCLRLLEATGISTVPGSGFGQKEGTFHVRTTILPSEKDMPAIMESFKMFNADFMAQYSDSKSKL

SEQ ID NO: 1097 - protein, 561 aa, Botryotinia fuckeliana
MKNSFFSSLAKFASLSLAFALPTAEVIPSALEERQSCANTATTRSCWGQYSASTNSYTTVPKTGYWLVVQNTTLSADGVSRPTLNFNGTIPGPQITADWGDDVIVHVTNKLTSNGTSIHWHGIRQLNNAQYDGVPGITQCPIAPGGTLTYKFHADNYGSSWYHSHFILQYGDGLFGPLVINGPATANYDVDLGMLFLNDWNHVPVQSLWDKAKTGAPPTLLTGLMNGTNTYNGAGKKFQTTFTPGLKYRIRVVNTAVDGHFQFSIDGHSFQVIAMDFVPIVPYNATSILVSIAQRYDIIVTANAAVGNYWIRAGWQTACSGNTNAANITGILRYTGSSSTADPTTTSTVTASTSCLDEPLASLVPFVPINPVASSIMKTTLTTGGGQWLFNGSSLLLNWTDPTLLTVLNSGNIWPTEYNVIPIESTTANKGWAVLAISGPNGPNHPIHLHGHDFWTLSQGTGAYTATTALNLVNPPRRDVMTLPTGGHLVIAFQIDNPGSWLMHCHIAWHASEGLALQFVESESSILPTIGTADVSTFQNTCAAWKAWTPTEPFPQDDSGI

SEQ ID NO: 1098 - protein, 586 aa, Liriodendron tulipifera
MGLSLLPSSATIVAFLLALSSLFFLPELAHSKHARITRHYKFDIQMRNVTRLCHTRNILTVNGQFPGPKIIAREGDRVVVKVVNHVANNVTLHWHGVRQLRSGWADGPAYVTQCPIQTGQSFVYNFTIVGQRGTLFWHAHISWLRSTLYGPIVILPKRGVPYPFAKPYKSVPIIFGEWFNVDPEAIITQALQTGAGPNVSDAFTINGLPGPLYNCSAKDTFRLSVEPGKTYLLRLINAALNDELFFSIANHTLTIVDVDAIYVKPFDTDILLITPGQTTNVLLKTKPHYPNATFFMSARPYATGRGAFDNTTTIGILEYQKPNSSHPSNAIGIKDLPLFRPSLPGFNDTTFAANYTRRLRSLANAKFPANVPQTVDRRFFFTVGLGTQPCPNNQTCQGPNGTKFSASINNVSYVQPTTALLQAHFFGQSNGVYSTNFPTKPPFPFNYTGTPPNNTMVSNGTKVVVLPFNTTVELVLQDTSIQGAESHPLHLHGYNFFVIGQGFGNYNPNKDPSNFNLIDPVERNTVGVPAGGWVAIRFQADNPGVWFMHCHLEVHTSWGLKMAWVVLDGKLPNQKLPPPPSDLPQC

SEQ ID NO: 1099 - protein, 240 aa, Zea mays
TRVEFCKNEGLVLLADEVYQENIYVEDKPFHSFKKIARSLGYTDDDLPLVSFQSVSRGYYGECGKRGGYMEITGFSPEVREQIYKVASVNLCSNVSGQILASLVMNPPKAGDESFESFMSEKDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSKLKEFHEKFMDEFRD

SEQ ID NO: 1100 - protein, 585 aa, Liriodendron tulipifera
MAPLLQTSGPMAALLLALSAIFLFPELSHAKHAGITRHYKFNIRLQNVTRLCHTKSIVTVNGRFPGPKIFAREGDRVVVKVVNHVQNNITLHWHGVRQLRSGWADGPAYVTQCPIQTGQTYVYNFRIISQRGTLFWHAHISWLRATIYGPIVILPKHGVPYPFIKPYKEVPIIFGEWFNADTEAIITQALQTGGGPNVSDAYTINGLPGPLYNCSARDTFRLSVKPGKTYLLRLINAALNDELFFSIANHTLTIVDVDAIYVKPFDTDILLITPGQTTNVLLKTKPHYPNATFFMSARPYATGRGTFDNTTTVGILEYQKPNSSHPSNAIGIKNLPLFRPSLPGLNDTAFAANYTRRLRSLANAQFPANVPQTVDRRFFFTVGLGTQPCPKNQTCQGPNGTKFAASVNNVSFVLPTTALLQTHFFGQSNGVYTTNFPTNPPFPFNYTGTPPNNTMVSNGTKVVVLPFNTSVELVMQDTSIQGAESHPLHLHGFNFFVVGQGFGNYNPNKDPSNFNLIDPVERNTVGVPAGGWVAIRFQTDNPGVWFMHCHLEVHTSWGLKMAWVVLDGKLPNQKLPSPPSDLPKC

SEQ ID NO: 1101 - protein, 486 aa, Oryza sativa Japonica Group
MSTAAAGAAPVSLDTINPKVLKCEYAVRGEIVTHAQLQQELQKNPDSLPFDEILYCNIGNPQSLGQQPVTFFREVLSLCDHPALLDKSETHALYSDAIERAWQILDKIPGRATGAYSHSQGIKGLRDEIAAGIAARDGFHASGDNIFLTDGASPAVHMMMQLLIRSENDGILCPIPQYPLYSASIALHGGSLVPYFLDEETGWGLEVDELKKQLEEAQSKGITVRALVVINPGNPTGQVLAEENQKKIVEFCKNEGLVLLADEVYQENIYVEDKKFHSFKKIARSMGYTDDDLPLVSFQSVSKGYYGECGKRGGYMEVTGFSADVREQIYKVASVNLCSNVSGQILASLIMNPPKAGDESYESFMVEKDGILSSLARRAKALEEAFNSLEGITCNKAEGAMYLFPRIYLPQKAIGAAQAAGTAPDAYYARRLLEATGIVVVPGSGFGQVPGTWHFRCTILPQEDKIPAIISKFKEFHEKFMDEFRD

SEQ ID NO: 1102 - protein, 485 aa, Moorella thermoacetica ATCC 39073
MSQKQPAKIVMVSNRGSYNLQATRDGIQVVPAISGLVSAVEPFLREKGGVWVAWGGREAPQENSPGLRLPVPEGNPAYTFREVPLTADEINLYYHGFTNSALWPLCHYFLEKCRYEVREWSAYVDVNAKFAAATLEEAGERDTVWVNDYHLALVPAHLRHRRPQLKQFFFWHIPFPHHDLLATLPWATHILRGLLGTDVLGFHLQAYVDNFLQAVAHMLGARVDFEAGIVFWEQRRIHVGAWPMGIDYQAFQRQAASPATMARAQKLREQIGVERLALSVERLDYTKGILERLLAWERLLEEAPEWRGRAALIQVAVPSRTAVPAYRQLKEQVEATVGRINGRFSDGNYQPVYYFWRGLPRRELVAYYLAADVMLVTPLRDGLNLVAKEYVASRRDQTGVLVLSRFAGAAQELKGAVLVNPYDIDGMAMIFNTALGMGRAEQSKRLQLLQERVRRHDVHWWMNCFHQAMAVREGETGDVSGSAGS

SEQ ID NO: 1103 - protein, 366 aa, Populus tremula x Populus tremuloides
QMGLAENQLCFDLIQDWLKKNPKASICSPEGLNEFREIAIFQDYHGLPEFRSAVANFMEKVRGNRVTFDPDRIVMSGGATGAHETVAFCLADPGEAFLVPAPYYPGFDRDLRWRTGVKLIPVDSDSSNSFMVTREALENAYEKAQLDNIKVKGLLITNPSNPLGTILDRETLRSIVRFINEKNIHLVCDEIYAATVFSQPDFISVAEILQEDIECNLDLVHIVYSLSKDMGFPGLRVGIIYSYNDAVVSCARKMSSFGLVSTQTQYLIASMLSDNEFVEMFIRESKSRLAARYRVFTRGLDQVGIECLKTSNAGLFLWMDLSRLLKEQTFKAEMGLWRVIIHEVKLNVSPGCSFHCSKPGWFRVCF

SEQ ID NO: 1104 - protein, 304 aa, Glycine max
  misc_feature (26)..(26): Xaa can be any naturally occurring amino acid
  misc_feature (43)..(43): Xaa can be any naturally occurring amino acid
  misc_feature (56)..(56): Xaa can be any naturally occurring amino acid
  misc_feature (77)..(77): Xaa can be any naturally occurring amino acid
  misc_feature (208)..(208): Xaa can be any naturally occurring amino acid
HYGSINENVKKSQYAVRGELYLRASXELQKEGKKIIFTNVGNXPHALGQKPLSFRXRRVVALCQAPFLLDDPNVGLXFPADAIARAKHYLSLTSGGLGAYSDSRGLPGVRKEVAEFILRRDGYPTDPELIYLTDGASKGVMQILNTIIRGQDDGILVPVPQYPLYSATIALLGGTLVPYYLEETANWGLDVNELRQSVEQARFKGITXVKAMVIINPGNPTGQCLSEANLREVLQFCYQENLALLGDEVYQTNIYQDERPFISSRKVLMDLGPPISKEVQLISFHSVSKGYYGECGQRSGYFEM

SEQ ID NO: 1105 - protein, 405 aa, Actinobacillus pleuropneumoniae serovar 1 str. 4074
MERFPKSDKLANVRYDIRGAIHKEALRLEEEGNKILKLNIGNPAPFGFEAPDEIVVDVIRNLPKSQGYCDSKGLYSARKAIVQYYQSKGIRNVDVNDVYIGNGVSELITMSMQALLNDGDEMLIPMPDYPLWTAAATLAGGKAVHYLCDENNEWMPDIEDIKAKITPRTKGILVINPNNPTGAVYSRSMLLEIAEIARQHNLMIFADEIYEKIIYDGAVHHHIAALAPDLLCVTYNGLSKAYRVAGFRQGWMVLSGPKNQARGFIEGLDMLASMRLCATTPMQHAIQTALGGYQSINEFVLPGGRLLEQRNKMYELLVQIPGISCVKAKGALYMFPKIDTEMYGIKDDAKFIYDLLQAERVLLVQGSGFNWHKPDHFRVVTLPYAHQIEEALGRLANFLKTYKQS

SEQ ID NO: 1106 - protein, 365 aa, Populus tremula x Populus tremuloides
QMGLAENQLSVDSIIDWIEKHPEASICNPEGVHMFKDIANFQDYHGLPEFRQAIAKFMGRVRGGRVAFDPDRIVMSGGATGANELIMFCLADPGDAFLVPSPYYPAFYRDLGWRTGVQIVPVDCDSSNNFQITKGALEAAYDKAQQNGINVKGLIITNPSNPLGTTLDRETLKSLLSFINEKNIHIVCDEIYAATIFGSENFVSISEVVEEVMDCNRDLIHIVYSLSKDMGLPGFRVGIVYSYNDAVVNCGRKMSSFGLVSSQTQYLLASMLSDEEFVEDFLAGSSKRLKKRHGVFTKGLEQIGISCLESKAGLFVWMNLRHLLKEQTNDGEMALWRVIVNDVKLNVSPGSSFHCVEPGWFSVSS

SEQ ID NO: 1107 - protein, 516 aa, Coprinopsis cinerea okayama7#130
MLSIFSLFALQSLPAALAAFGSSGNLIVGNKFISPDGFNRSAVLAGSSRNGLTFPGPVITGIRGSRFNLNVVNELTDPTMLRTTSIHWHGLFQRGSQWADGPAGVTQCPIVPGSSFLYQYRVPDQAGTFWYHSHHQSQYCDGLRGALVVYDPRDPHRRLYDIDNESTIITLADWYHVPAPSAGVVPTFDSTLINGKGRYAGGPAVDLAVINVERNRRYRFRLISISCDPNYIFSIDGHQLTVIEVDGINVQPHTVDSIQIFVGQRVSFVLHANRPVGNYWIRADPNFGTTGFAGGINSAILRYRGAQPVDPVTERLPFSNPFREVDLRPLVPKRPPGRPEIGGADININLDIGFDPSSITFSVNNATMLQPTVPVLLQILSGARTPQELMPQGSIYVLPRNKVVELSIPGGSVGSPHPIHFHGHTFHVIRSAGSSEYNYFNPIERDVVNIGESTDNVTIRFKTDNAGPWILHCHIDWHLVLGLSVVFAEDVSSIARLNAPPAWHELCPKYEAFGEE

SEQ ID NO: 1108 - protein, 982 aa, Chlamydomonas reinhardtii
MAARDHGFEGHWVYMPACQPLPSKFEWSRDMSPAQADLLAQLPFTLAVPQYGVAVVHAGLVPGVPLKQQKLWACYKMRNLVPHPHGDGGGGGGGGGSTSGSGGADPATATSASTSTSTSAGTLTATASSTVTGHAPGARYTAVEKAKEGGQAWAPLWPGAEPPAQHVFFGHDAKRRLQLAPHATGLDTGCVYGGELTAAVLPPLGELVASSPGFVAAMRHGRPLTREDLRVQLVSVPAARVYSAPDGHADTAAAGAATAAAAAMARKASPAWCLSAALLLVALGIASAGPALVPDSVKPDPKGDGYIVSFTLNVTVAYGAPSCFARSIVLTSGYFEPAIVINQGDTLRINLINNIPASFPTVSDGISIHYHGLRMSGPAAWLDGVSYIGLCPVAPGSSYQYEFKVNDPPGTYLWHDHAAGFKGDGLEGPLIVLPPRAGPPVLPQPGAAPAWPPAAQPDLWSYDGDETLFLGDWYHATTSSMLFRLNQPFDNAKVTNDSGAWNWVGNPQAVLVNGAGFYGDCSLYPVAGGGPTPPACAPSAFTVAAGRSAQQPWASNNNPGCTHTQVTVQPGKTYRLRLVNAALLVYMTVCFEGHNVTLIAADAVPVAPVSTQCVDVNSGQRIDVLLKADQPAANYWISVVPQYRTGAPAGYAVLHYAAAGVNASTFPATTAPQPVSITPWSDSMNAKVVLAPELLVPSTDPKVARYRRPGQASLAPPAAASKLVYVNLSQPLFNENGQLRWALDNVAMPRTPPCQPLLSSLRKDPKYLTKQAVPASQLNGTGVGPNVLVGTAGKSRTTPVYYEGLSPVPVYPSVGLHIVELAGGAVVDLIVNNNPANSFNGDLRPVDGPTRIAMEQHPFHLHGHRFWVLGRGTGGNYNASAHAAGLNTANPSYRDTVTIAAGGWAYLRFVADNPGIWPFHCHILPHIFMGQQLYFVEDIKNLAPPPSKTPKCPSACRYNFAPYTKSWLRAKYGMSGWELPPL

SEQ ID NO: 1109 - protein, 1065 aa, Candida glabrata CBS 138
MTIIVASLFLPFQPQFEVNADQEQTAELVDSKLVKISGEQEAHANKNLPDVRVQETDAYATAATQPFLNSRTPLALSSAASQLNVKQGPLSSEQFLENLTANATTAGTPVNPNLGVHGHASAEDFFTTNNSTAINNNASSPPFSVSSIAPEINANVDGTDTMDVTADLLDNVNKSLLLHSVLNSGQGVSSPNAVEGHTATHLTNPNTTVITPKSRAVPESNPGVVNFDNYKERRDSQSNSAFPSMKRVASGSHGPSHLKYSQNAIDAALESDVIDDADDRQNSEAESDYETDRKVHYNVPGFGGYSSTSKRLKNSLEIFSRVPWKIVPSRKGNGALKNAINTSILEKDIKDGVKWVGTLGIPTDEIPVETTKKIVKDLNENYQSSAVIADDVTFKGAYKNFCKQILWPTLHYQIPDNPNSKAFEDHSWNYFQRLNQYFAEKIVSIYEDGDIVWVHDYHLMLVPGMVRQKLPNAKIGFFLHVSFPSSEVFRCFAQRENMLEGILGANFVGFQTAEYARHFLTTANLLLTADVSGDHLRYKGKVVSVKSTPIGIDAFDLANQLLTDPVTKWRQLIRQRWAGKKLIVCRDQFDKIRGLHKKLLAYERFLRENPDYIEKVVLIQICIGKSSDPELERKVMVVVDRINSLSISISVSQPVVFLHQDLDFAQYLALSSEADLFLINTFREGMNLTCHEFIVCSREKNSPLLISEFTGSAELLKDGAILINPWDTRHLAKCIKMGLEMPLDERKRRWKIMMKSLINNDSTNWIMSNLQAIEHCWEFSKESSTLFSLSSEELASEYQSASNKLFILKISEPPSPRMLAILRELSSRCTVYIMNTFSKTTLENLYGRVGNLGLIAEGGAYVRLNGTWYSIVDHVDWLEEVTKILDTKIERLPGSYYKLADSMVRFHTENAEDQDRVASVIGEAMTHINTLFADRGIHAYVHKNILFVQQKELSLETTKFILKFHNSGKVYNTGHSTPSKHNNEMSAMFSGQSDTIDFICVAGSTSPTIEPIFKLVKDATLAGNLRYGHTIVYGDAPSTYAREHTSGWNELFNIFQDLAKSNERQ

SEQ ID NO: 1110 - protein, 522 aa, Trametes sp. 420
MAKFQSLLTYIILSLAATAFAGIGPKTDLTIADGDVSPDGFTRAAILVNNQFPSPLITGNKGDRFQLNVVDNLTNHTMLKSTSIHWHGFFQHGTNWADGPAFINQCPIASGHSFLYDFQVPDQAGTFWYHSHLSTQYCDGLRGPFVVYDPQDPHASLYDVDDDSTVITLADWYHTAARLGPAFPLGADSTLINGLGRSTSTPNAELAVIKVTKGKRYRFRLVSLSCDPNHVFSIDGHTLNIIEVDSINTEPHTVDNLQIFAAQRYSFVLTADQDVGNYWIRANPNFGTTGFADGVNSAILRYDGAAEDEPTTSQTPFSNPLVETDLHTLDALTVPGTATRGGVDLAINMAFNFNGTNFFINGASFTPPTVPVLLQILSGASAAQDLLPSGSVYALPSNADIEISLPATAAAPGAPHPFHLHGHAFAVVRSAGSSTYNYDNPVWRDVVSTGTPANNDNVTIRFRTDNPGPWFLHCHIDFHLEAHLSFRSLFLNPRRHGQVSVSAHLHHPLSRRDRVRWHRSKD

SEQ ID NO: 1111 - protein, 618 aa, Debaryomyces hansenii CBS767
MKLCELLFISFIVSLVNAKTHTWYFKTSWVDANPDGVKERKVIGFNDTWPLPTLRVNKGDRVNLYLTNGFDTANTSLHFHGLFQNGSSQMDGPEMVTQCPIPAGETMLYNFTVADQVGTFWYHSHTKGQLGDGMRAPFIIEDDDYPFDFDEEVVLSLSDWYHEKSDDLIEDFMSRYNPTGAEPIPANLLFNETRNNSWVVEPNKTYFVRIVNIGGFVTQYLWMEDHEFEVVEIDGIYVEKNKTDMLYITVAQRYGVLIKTKNSTDKNYAMMTRFDDTMLDIIPDELELNSTNYMVYNEDKDMPKEYKVDSIDDFLDDFYLKPLSKEKLYDDADQTITIDVTMDNLGDGVNYAFFNNLTYIKPKLPPLMTVLSSGEHATNELVYGSNTHTYVLQDNDVIDIVLNNGDTGRHPFHLHGHVFQLIARGSAVDDDDDPVTYGDEEDDVEFPEYPMMRDTVYVEPQSYMVLRFKADNPGVWFFHCHIDWHLIQGLAIVLVEAPLAIQADPRQKLQDDVKKHCEMLDMPYEGNAAGNSKDYLDLTGQNVQVAYLPSGFTARGIVALVFSCIAGFLGVVMIAVYGMADIPDVEERVARDLDVDIDEYEVNTSSTEQASIVEERTH

SEQ ID NO: 1112 - protein, 172 aa, Vibrio parahaemolyticus RIMD 2210633
MKIGLFYGSTTCYTEMAAEKIRNIIGADLVDIHNVKETPLSLMAEYDLLLLGISTWDFGEIQEDWSAIWQDIASTPLKGKVVALFGLGDQEGYGEWYLDAMGLLHDELKATGAQFIGYWPNEGYEFEASKALTEDGSQFVGLALDEDSQYDLSDERIEKWCEQVLVEFHDTL

SEQ ID NO: 1113 - protein, 168 aa, Anabaena sp.
KKIGLFYGTQTGKTESVAEIIRDEFGNDVVTLHDVSQAEVTDLNDYQYLIIGCPTWNIGELQSDWEGLYSELDDVDFNGKLVAYFGTGDQIGYADNFQDAIGILEEKISQRGGKTVGYWSTDGYDFNDSKALRNGKFVGLALDEDNQSDLTDDRIKSWVAQLKSEFGL

SEQ ID NO: 1114 - protein, 455 aa, Solanum tuberosum
KAYDSDPFHPLKNPNGVIQMGLAENQLCLDLIEDWIKRNPKASICSNEGIKSFRAIANFQDYHGLPEFRRAIAKFMEKTRGGRVRFDPERVVMAGGATGANETIIFCLADPGDAFLVPSPYYPAFNRDLRWRTGVQLLPIHCESSNNFKITSKAVKEAYENAQKSNIKVRGLILTNPSNPLGTTLDKYTLKSLLSFTNQHNIHLVCDEIYAATVFDTPQFVSIAEVLDEKEMTYCNKDLVHIVYSLSKDMGLPGFRIGIVYSFNDDVVNCARKMSSFGLVSTQTQYFLAAMLSDEKFVDNFLTESAIRLAKRHKHFTNGLEEVGIKCLKNNAGLFCWMDLRPLLRESTFDSEMSLWRVIINDVKLNVSPGSSFECQEPGWFRVCFANMDDGTVDIALARIRRFVRVEKSGDESSAMEKKQQWKKNNLRLSFSKRMYDESVLSPLSSPIPPSPLVR

SEQ ID NO: 1115 - protein, 795 aa, Arabidopsis thaliana; identical to SEQ ID NO: 928

SEQ ID NO: 1116 - protein, 425 aa, Xylella fastidiosa Dixon
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIAAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKLRSAAA

SEQ ID NO: 1117 - protein, 612 aa, Candida albicans SC5314
  misc_feature (604)..(604): Xaa can be any naturally occurring amino acid
MRFIVSSFIFFISFLSSLITAETHTWYFKTSWVDANPDGVFPRKMIGFNDSWPLPTLRAKKGDRIQLYLINGFEDLNTTLHFHGLFQHGTNQMDGPEMVTQCPIPPGETYLYNFTIDDQVGTYWYHSHTSGQYGDGMRGVFIIEDDDFPYDYDEEVVLTLSEHYHDYSKDLMPGFLSRFNPTGAEPIPSNILFNETRNNTWKVEPGKTYFVRIINIGRFVTQYLWMEDHEFTVVEVDGVYVEKNTTDMLYITIAQRYGVLITTKNSTDKNYAFMNRVDDTMLDTIPKDLQLNGTNYIVYNESAPLPDAYDVDSIDDYLDDFYLKPLNKEKLLDDADYTITVDVQMDNLGNGVNYAFFNNITYMTPKVPTLLSVLSAGDASTNELVYGSNTNSFVLQGGDVVDIVLNNLDTGRHPFHLHGHVFQLIERHKEIPDTEDPVSYNVSDHAEWPEYPMSRDTVYVKPQSYIVMRFKADNPGVWFFHCHIEWHLDQGLAIVLIEDPEAIQKNSSQHLTDNHKQICEKVGVSWEGNAAANSNNYLDLKGENIQVKRLPTGFTARGIVALVFSCIAEFLGIAAIAYYGMNDIEDLEEKSGKRFGCGIWMKKXRRKKKQKL

SEQ ID NO: 1118 - protein, 624 aa, Candida albicans SC5314
MRTFLSSFIILTTFLASLIAAETHTWYFKTGWVDANPDGVYPRKMIGFNDSWPLPTLRVKKGDRVQLYLINGFDNLNTTLHFHGLFVRGANQMDGPEMVTQCPIPPGETYLYNFTVTDQVGTYWYHSHTGGQYGDGMRGVFIIEDDDFPYHYDEEVVLTLSDHYHKYSGDIMPAFLTRFNPTGAEPIPQNFLFNETRNATWKVEPGKTYFVRILNIGGFVSQYLWMEDHEFTIVEIDGVYVEKNTTDLIYITVAQRYGVLITTKNSTDKNYAFMNGVDTTMLDSVPADLQVNGTNYIVYNESSALPDAYDIDSYDDALDDFYLKPLSKQKLMDDADYTITVDVQMNVLNDGINYAFFNNISYKAPKVPTLLTVLSAGEAATNELIYGTNTNSFVLQGGDIVDIVLNNFDTGKHPFHLHGHVFQLIERHEAIGSKESAVTFNVSDHAEWPEYPMIRDTVYVKPHSYMVLRFKADNPGVWFFHCHVDWHLEQGLAIVLIEDPQAIQKNEKITENHKRICEKVGVPWEGNAAANSNDYLDLKGENVQVKRLPTGFTTKGIVALVFSCVAAFLGLFTISFYGMNDIAHVEDKVARDLDIDLEAENEDEEEAVVLNQNSSSSDSNSKPH

SEQ ID NO: 1119 - protein, 175 aa, Idiomarina baltica OS145
MATVGIFFGSDTGNTEAVAHMIEKELGKKLVEVKDIAKSSKEDIASYDLLLFGIPTWYYGEAQCDWDDFFPELEEIDFTDKLVAIFGCGDQEDYAEYFLDAMGMVRDIVEARGAIIVGHWPTESYHFEASKGLVDENHFVGLGIDEDRQPELTKDRVTQWCKQVYEEMCLAELAN

SEQ ID NO: 1120 - protein, 496 aa, Trametes trogii
AIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGSPVPTADATLINGLGRSIDTLNADLAVITVTKGKRYRFRLVSLSCDPNHVFSIDGHSLTVIEADSVNLKPQTVDSIQIFAAQRYSFVLNADQDVGNYWIRALPNSGTRNFDGGVNSAILRYDGAAPVEPTTSQTPSTNPLVESALTTLEGTAAPGSPAPGGVDLALNMAFGFAGGKFTINGASFTPPTVPVLLQILSGAQSAQDLLPSGSVYSLPANADIEISLPATAAAPGFPHPFHLHGHTFAVVRSAGSSTYNYENPVYRDVVSTGSPGDNVTIRFRTDNPGPWFLHCHIDFHLEAGFAVVMAEDIPEVAATNPVPQAWSDLCPTYDALSPDDQ

SEQ ID NO: 1121 - protein, 669 aa, Oryza sativa Japonica Group
MEMAANPGGSGTCSDALFRELWHACAGPLVTVPKRGERVYYFPQGHMEQLEASTNQQLDQYLPMFNLPSKILCSVVNVELRAEADSDEVYAQIMLQPEADQSELTSLDPELQDLEKCTAHSFCKTLTASDTSTHGGFSVLRRHAEECLPQLDMSQNPPCQELVAKDLHGTEWHFRHIFRGQPRRHLLTTGWSVFVSSKRLVAGDAFIFLRGESGELRVGVRRLMRQVNNMPSSVISSHSMHLGVLATASHAISTGTLFSVFYKPRTSRSEFVVSVNKYLEAKKQNLSVGMRFKMRFEGDEAPERRFSGTIIGIGSVPAMSKSPWADSDWKSLKVQWDEPSAIVRPDRVSPWELEPLDASNPQPPQPPLRNKRARPPASPSVVAELPPSFGLWKPPSEAAQTLSFSEPQRAREIFPSIPASIFSASSHVEFNSKNEPSILSNQFYWSMRDSKTDSFSASTNKTRVERKQEPTTMGCRLFGIEISSAVEEALPAATVSGVGYDQTVLSVDVDSDQISQPSNGNKSDAPGTSSERSPLESQSRQVRSCTKVIMQGMAVGRAVDLTKLNGYGDLRSKLEEMFDIQGDLCPTLKRWQVVYTDDEDDMMLVGDDPWDEFCSMVKRIYIYSYEEAKLLAPKSKLPVIGDTIKLSSMNSSHESVDLDNHASVTNRDC

SEQ ID NO: 1122 - protein, 942 aa, Arabidopsis thaliana
MPGNKYNCSSSHIPLSRTERLLRDRELREKRKSNRARNPNDVAGSSENSENDLRLEGDSSRQYVEQYLEGAAAAMAHDDACERQEVRPYNRQRLLVVANRLPVSPVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVKQHMKELKERFTDRKVMLGVDRLDMIKGIPQKILAFEKFLEENANWRDKVVLLQIAVPTRTDVPEYQKLTSQVHEIVGRINGRFGTLTAVPIHHLDRSLDFHALCALYAVTDVALVTSLRDGMNLVSYEFVACQEAKKGVLILSEFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSP

SEQ ID NO: 1123 - protein, 479 aa, Oryza sativa Japonica Group; identical to SEQ ID NO: 345

SEQ ID NO: 1124 - protein, 142 aa, Alkaliphilus metalliredigens QYMF
MKKISIIFGSTTGNTERVAEIIKDNMAECEVTVTDVCNAKDEMIKSADTVLFGASTWGYGEIQDDFLEYYNSMKSELLSAKDVAVFGCGDSVGFSDVYCRAVDLIIEKASECGANVIGEGLKVDGDVDDNVSKIEAFAKELV

SEQ ID NO: 1125 - protein, 484 aa, Oryza sativa Japonica Group
MAAPSVAVDNLNPKVVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 1126 - protein, 466 aa, Erythrobacter sp. SD-21
MSTDARLVVISNRVAVPKARGAAGAQGGLAGALHSALTSRRGLWFGWSGEESESGRTGNIATQTSDGVTTATIDLSKRDVEEYYNGYANSTLWPLFHYRLDLAKYERETGKGYERVNERFAELVTPLIEPDDVVWVHDYHLIPLGERLRAQGCKNRIGFFLHIPWPATRLFVSLPYHERLVRTMLHYDLVGFQTKEWLDSFLHYCRSELGAEVNEETSEITLDGNTTMARAYPIGIDWEHFSKLGETGEARQAQQRLMSSTRRRTAMIGVDRLDYSKGLPERLDGISRFFDRHPERVRDLVFAQIAPPSREDVDSYQAIRATLEQKAGQINGARSEVDLVPVRYVNRGYSHAELFGFFRAAKIGLVTPLRDGMNLVAKEYIAAQDPEDPGVLILSRFAGAAAQLQDAVLVNPHSPDDLAHAIRVALDMPLEERKERYENLVATVRDDDVQDWTETFLTDLDNIPIA

SEQ ID NO: 1127 - protein, 437 aa, delta proteobacterium MLMS-1
MRTDIVHIGAGELTYEIRNIVNVGEKLQKLGIKTYWENIGDPVAKGEEIPLWMKKVVAEYVMQDASYGYCPTRGILTTREFLAAEVNRRGGVQIGPDDILFFNGLGDAISKVYGMLRRNARVVMPSPSYTTHSSGEASHAGDRPVCYRLDPHNHWYPDLDDLEKRIKYNPAVAGILLINPDNPTGAVYPEEILRGFVALARKYDLFIICDEVYQRIVYNGRQTKALAEVIGDVPAINMRGISKEMPWPGSRCGWIEVYNADKDPMFAKYVASILNSKMVEVCSTTLPQMVLPAIITHPEYNSHLAERVKRYERASNVAYDILKEVDGLIVNRTDGAFYMSVTFEPGILHDRQSLPIENREVREHVEQLVNQPGTAPDKRFVYYLLGSTGICVVPLSSFATEIQGFRTTLLERDEDRFRRICQTMADAIRQYLASSGQ

SEQ ID NO: 1128 - protein, 493 aa, Propionibacterium freudenreichii subsp. shermanii
MSEDQLSIPSAPANDGRTEDPVPRDAPAAGTSQFVVVANRLPVDRVQNDDDSSGWALSPGGLVTALIPVMKDHGGTWVGWVGSADEHIQPFTFDGYGIMPVDLSAQEFNEYYEGMSNATFWPLYHDCVEHPEYHREWWDSYMEVNQRFATAAAEVAAPGATVWVQDYQLQNVPALLRQMRPDLKIGFFLHIPFPPSELFMQLPWRYQVISGLLGSDQIGFQDPGSARNFAHLVRRLAGMRTQGDRIFSPDGRVILARAYPISIDAQGILDLSRTPQARAEAEQLREDLGNPDKIFLGVDRLDYTKGLRHRVRAFGELFTSGQLDPMRNVYLQIATPTREGVARYQVLRSIIDEMVGRINSSVGRIGRSPIEYRHASYPKMALAAMYRAADVMVVTPLRDGMNLVAKEYVASHDSDAGALVLSEFAGASLELKQAYMVNPYDLNGMKNQLLRAAGDTHANHVRRMRSMRKQVFRHDIDAWANSFLTDLGTERSV

SEQ ID NO: 1129 - protein, 449 aa, Arabidopsis thaliana; identical to SEQ ID NO: 714

SEQ ID NO: 1130 - protein, 461 aa, Physcomitrella patens subsp. patens
MYTQVIKTEYAVRGEIVTRAQNLEQELITKPGSLPFEEIVYCNIGNPQSLSQPPVTFFREVVALCDHPNLLDKSETHALFSSDAISRAFRIIDNIPGRTTGAYSHSQGIKVCREDIAAGIEARDGFPADPEDIFITDGASPGVHMMMQLLITSEKDGILCPIPQYPLYSASIALHGGTLVPYYLNESAGWGLEMNELKQQLKAARDAGTNVRALVVINPGNPTGQQVLSEENQRDVVQFCKEEGLVLLADEVYQENIYAPDKKFNSFKKVARSMGLQDKDLNIVSYHSVSKGYYGECGRRGGYMEVTGLPKDVKDQLYKVASVNLCSNISGQVLMSLVTNPPKPGDESYELFAEERDAILGSLGRRAKVLTEGMNKLEGVTCNAAEGAMYVFPRLDLPERALKAAGAVGMLADVFYTRRLLDATGVVMVPGSGFGQVCNTLLRSTCAYFPICREDVRTIIR

SEQ ID NO: 1131 - protein, 533 aa, Coprinopsis cinerea okayama7#130
MSFAWKALATLAVAIASRSAFAQSIIGNQDTMTISNINAGPDGFTRPVIAVNGEFPSPLVRANKGDDFRINVVNNLDDDTMLRQTSVHWHGVFQHQSAWADGPDGVTQCPIPQSGQEFEYAFNAGQEAGTFWYHSHYGTQYCDGLRGPLVIYDPEDPHQDLYDVDDENTIITLADWYHLQAPSIQGPAVSQATLINGKGRRPGNTEGDIAVVNVEKDSRYRFRIVSLSCDPDYTFSIDNHTMTIIEADGQNTKPLEVESIRVFAGQRYSVVVNADQAIGNYWIRAEPNIGDTGLVGTSGGGVNSAILRYATADEVEPDTPRLTNRPALQESNLRALTSGVPGGDGPADITFTFNLGLNFATGTFSMNPGESWVHPDTPVMVQIMNGVPAEDLVPAESLHTITRGQVVEVVIPPFGIAGPHPFHLHGHAFSVIKSAGGSPNFVDPVRRDVVAVGTEAGQGDTIIRFVADNPGPWFFHCHIEFHLVTGLAAVFMEAPDEIASSNPPPPSWDALCPAFSALPPSATSIRIVPTPTP

SEQ ID NO: 1132 - protein, 1020 aa, Magnaporthe grisea 70-15
MSQDAASAPSDLGAQTQQPHQAGNGGTNSSHGTDNIAKRALKLGTSTSLSPELPPTGLQEEVPVTPGITTAAYHDFEFDNGESGGGPGYFSRRGQNMMTTPVGKGVEDDGLGPSASSSAPDPEVLKRINQFRLGGRKESLTNIRAMNPDLSLSGNIISATFNIPYSLEYRKGADWVLNPRRGQSALFDSLSHLSSDNTPWNHTVVAWTGEIEPPSDLPSPPATPPATTTNLPALNSLSKPIPVNGEAPAPAPSHAEGLWIPREDQLRLESQLSHNAKIKTSAVWLSDSNEATEEGITLKDQARWRRFAEHELYNLFHYKQHEPNDGRKERVQWADYYRMNQKFANKIIENYKPGDIVIIHDFYLMLLPSMLRQRAPHIYIAFFLHSPFPSSEFFRCLPRRKEVLEGVLGSNMIGFQSYSYSRHFSSCCTRILGYKSDARGVNVYGSRVEVGVFPIGIDAKKVEQLAWSDSVNKLVQQLQTQTTQGRKLIVGRDRLDSVHGVAQKLKAFERFLENYPEWRDKVVLIQVTSPTSIEEEKDESKVSTLVNELVLKINGMYGGLGFEPVRHFSQYIGQDEYFALLRGADIGLITSVRDGMNTTSMEYVVCQRDSHGPLILSEFSGTAGSLTDAIHINPWDFSAVADEINRALTMPPHKRQEMQTKLYEHVTTKTVHEWIGGVVAKLIQVLGSGQNPVKTPLLDRSALLRSYRAAGKRLFMFDYDGTLTPIVREPSAAVPTERLLQTIKALAADDRNAVWVISGRDQDFLSAHLGHIQNLGFSAEHGSFMKKPGSDEWENLADKFDMGWQEEVIAVFQKFTDKVEGPFIERKRCAVTWHYRPVVDQDLAQRLARECHKELEATVARKWEVEVMPGKMNLEVRPTFINKGAIAKRLVLDYNAELVAAGKNKLEFVLCMGDDFTDEDMFRSLNTLSVTADGATEPELKTEHVFSTTVGPSTKVTIARWHLLEPEDVVECVALLASGVSTELLANQGEGVAETVKPLRVSENNLAAISEVEGRVPDIE

SEQ ID NO: 1133 - protein, 174 aa, Prochlorococcus marinus str. MIT 9215
MTVGIYYATTTGKTEDVADRLHNFISSAESPKDVSDVDDLSEFEGLDGIICGIPTWNTGADEERSGTAWDSILEDIGELSLSGKKVAIFGLGDSSTYTENYCDAMEELHSYFIKAGAEMVGYVDKSTYTFDESKSVIGESFCGLPLDEDSESDLTDSRLETWASQLKGEIPALA

SEQ ID NO: 1134 - protein, 533 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDGTTVLTIADWFHNTSTELIAAAVAPLADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVRRDVTSVAIGNQTTIRFVTDNPGPWFLHCHIDLHLEFGLAVVMAEAPSLVKATDVTTPAWDELCPIYDSLTPAQLP

SEQ ID NO: 1135 - protein, 172 aa, Yersinia pestis CO92
MKIGLFYGSSTCYTEMVAEKIRDILGEDLVDLHNLKEVSPRLMEEYSILILGIPTWDFGELQEDWEAIWPQLTQLNLKGKIVAMYGMGDQFGYSEWFLDALGMLHDHIAPLGVKFIGFWPTDGFEFTSPKPLSADGKQFVGLALDEVNQYDLSEERIEQWCEQILLEMEALL

SEQ ID NO: 1136 - protein, 533 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDANHNFSIDGHRLTVIEVDGENHEPATVDNIQIFPGQRYSFVLNATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVRRDVTSVAIGNQTTIRFVTDNPGPWFLHCHIDLHLEFGLAVVMAEVPSLVKATDVTTPAWDELCPIYDSLTPAQLP

SEQ ID NO: 1137 - protein, 549 aa, Coprinopsis cinerea okayama7#130
MTSRLLGYLQLAIVLYNSVARGQMILSPSDTMVISNANVSPDGVTRSAVVVNGVHPGPVLIGEKDDVFAINVVNELTDPTMLRSTSVHWHGLFQRGTNWADGAEGVNQCPISPERSFLYRFSPAGHAGTFWYHSHFGTQYCDGLRGPMVVYDPDDPYKNEYDVDDVNTIITLADWYHTPAPSIRGPFFPDSTLINGIGRTPGGPKVDLAVVNVEAGKKYRFRIVSLACDVNFQFSIDKHKLTIIEADGQLTDPLEVDRIQIFTGQRYSVILNANQTPDVYRIRAIPNAGVHGLTDTTAGGVNSAILRYANAEATELPQEDELPSNLVDLQEWMLHAYAGGDPAAPGRPEAGGADVRIPLRFTFSGGRFFVNGTAYSSPSVPTLLQIMSGANPGELLPENSIYYLPRNQVIEVEIPSAGISASGPHPFHLHGHAFSVIRSAGNTSYNYVNPVKRDVVNIGGDSDLVTIRFVTDNPGPWFFHCHIEPHLVGGLAIVFAEAMKDTMSANPDVPDEWKDLCDIYDKLEPSLTSLSIIRRAEPTDLSAKFRGLY

SEQ ID NO: 1138 - protein, 898 aa, Oryza sativa Indica Group
MSRSYTNLLDLAAGNFEALGPAGGGRRRSFGAKRMTRVMTVPGTLSELDDEDDEPAATSSVASDVPSSAACERLIVVANQLPVVARRRPGAAARGWAFSWDDDSLLLRLRDGVPDEMEVLFIGTLRADVPACEQDEVSQSLIDGFGCAPVFLPAGLYDRFYQHFCKGYLWPLFHYMLPFASALPAAASGDGRFDRGAWEAYVLANKYFFEKVVEVINPEDDYVWVHDYHLMALPTFLRRRFNRLRIGFFLHSPFPSSEIYRSLPVREEILRTLLNCDLIGFHTFDYARHFLSCCSRMLGIEYQSKRGYIGLDYFGRTVGIKIMPVGIHMGQLQSVLRSSEKEKKVAELRQQFEGKSVLLGVDDMDIFKGINLKLLAFENMLRTHPKWKGRAVLVQIANPARGKGKDLEAVQAEIRESCDRINKEFGQLGYSPVIFIDQSVPSAVRLAYYTVAECVVVTAVRDGMNLTPYEYIVCREGIPGSECAPEVSGPKKSMLVVSEFIGCSPSLSGAIRVNPWNIEATAEALNEAISMSEREKQLRHEKHYRYVSTHDVAYWSKSFVQDLERACKDHFRKPCWGIGLGFGFRVVALDPHFTKLNFDSIIMSYERSKSRAIFLDYDGTLVPQASLNKNPSEELLRIINTLCADRNNTVFIVSGRSKDDLSKKLISCPKLGIAAEHGYFLRWTRDEEWQTTAQTSDFGWMQMAKPVMDLYTESTDGSTIETKETALVWHHQDADQGFGSSQAKEMLDHLESVLANEPVSVKSGQFIVEVKPQGVTKGLIAEKVLTSMKEKGQLADFVLCIGDDRSDEDMFENIADVMKRSIVAPKTPLFACTVGQKPSKARFYLDDTFEVVTMLSSLADASEPDLMADLEDDLATSVSSIEISDRVVSFSNLRTEGS

SEQ ID NO: 1139 - protein, 183 aa, Zea mays
  misc_feature (106)..(106): Xaa can be any naturally occurring amino acid
MRLTTENINQRVVAAKYAVRGELAVKSEEYRAKIAKGDTGDLPFNEIISANIGNPQQLDQKPITFFRQVASLLENPILLENEEALTKHFGYQTDVIERAKFLLSRXGSVGAYSASTGVPAIRESIAQFIERRDGFPADPEHIYLSAGASSGVNTLLNVICASPKTGILIPIPQYPLYTATLSL

SEQ ID NO: 1140 - protein, 417 aa, Gossypium raimondii
MKESDKSLDPQLWHACAGPMVQIPPLNSKVFYFPQGHAEHSLAAVDFPSSPPVPALVLCRVASLKFMADTETDEVYAKILLMPLPNTELDLEHVAVFGSDNAEKPASFAKTLTQSDANNGGGFSVPRYCAETIFPPLDYTEDPPVQTVVAVDVHGETWKFRHIYRGTPRRHLLTTGWSTFVNHKKLVAGDSIVFLRSENGGLCVGIRRAKRGTGNGPEAGSPFLSFLREDESKMMMMNRNGDWRGKGKLKAEAVLQAATLAASGQPFEVVYYPRASTPEFCVKASSVKAAMRVPWCCGMRFKMAFETEDSSRISWFMGTVSSVQVVDPIRWPNSPWRLFQLEELSTQVPQGLAWDNIGGPSIPPYNRLTAAQFEAFFHPPGANCSSQIGYSNDVVSDEMNGAVHSQNVNGYFPGWML

SEQ ID NO: 1141 - protein, 125 aa, Zea mays
  misc_feature (18)..(18): Xaa can be any naturally occurring amino acid
  misc_feature (20)..(20): Xaa can be any naturally occurring amino acid
  misc_feature (27)..(27): Xaa can be any naturally occurring amino acid
  misc_feature (45)..(45): Xaa can be any naturally occurring amino acid
  misc_feature (59)..(59): Xaa can be any naturally occurring amino acid
  misc_feature (72)..(72): Xaa can be any naturally occurring amino acid
  misc_feature (100)..(100): Xaa can be any naturally occurring amino acid
MGEGQLVFMHTVSKGYWXRXGQRGGYXETTYLTRTTVDEIYMWAXLVLEPDVPGHIFMXETAYPATHEDILXPKVTALGWLILETSKRRALMMTDCFNRXKNVVRASTNGVLYCVAKIQLSPRPI

SEQ ID NO: 1142 - protein, 563 aa, Vitis vinifera
MEQLQASTNQGVDQRIPLFNLPSKILCRVVHTRLLAEQETDEVYAQITLQPEADQTEPKSPDSCPDEAPKQTVHSFCKILTASDTSTHGGFSVLRKHANECLPPLDMSQATPTQELVARDLHGYEWRFKHIFRGQPRRHLLTTGWSTFVTSKRLVAGDAFVFLRGDNGELRVGVRRLARQQSPMPSSVISSQSMHLGVLATASHAVTTQTLFVVYYKPRTSQFIISLNKYLEAVNYGFAVGMRFKMRFEGEDSPERRFTGTIVGIGDISPQWSNSKWRSLKIQWDEPATIQRPERVSSWDIEPFVASASLNLTQPPVKIKRPRPLDLPVAVPSPFWYAGSSPSHELTQLDSKTVSTRSILSGYNTSLSSRPNNGLISDQVEKGKRIEASIGCRLFGIDLTNNSKATALLEMIQNLDVSKSSNEQKQVVPEASQKETQGRQSCTPSSRTRTKKVQMQGVAVGRAVDLTALEGYDELISELEKMFEIKGELCPRNKWEVVFTDDEGDMMLVGDDPWQEFCKMVRKIFIYSSEEVKKMSPRCKLSTSSLDGEGTVISLDSELRTEP

SEQ ID NO: 1143 - protein, 184 aa, Arabidopsis thaliana
MRRFLINQAKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIA

SEQ ID NO: 1144 - protein, 500 aa, Synechococcus sp. PCC 7002
MKSSLVILYHREPYDEVRENGKTFYRDKTSPNGIMPTLKSFFANAEQSTWVAWKQISGKQQENFQAKMAFPGQENSVVHRIPLSADQVKNFYHITSKEAFWPILHSFPWQFTYDSSDWENFKQINEMFAEAACEDADDDALFWVHDYNLWLTPYFIRQKKPNAKIAFFHHTPFPSVDIFNILPWREAIVDSLLCCDLCGFHLPRYVQNFVAVARSLRKVEITRQVPVDEHAFTAVGTALAEPEITTQLKYKDHLVNLDAFPVGTNPTQIRAQVEKASTQERIRKIREELGSNKLILSAGRVDYVKGTKEMLVCYERLLERRPELQTKVNLVVAAAKAASGMRVYKNAQSEIERLVGRINGRFAKLNWTPILLFTSALSYEELLGFFGAADIAWITPLRDGLNLVAKEYVVAHGCDDGVLILSEFAGSAVELPDAILTNPYAAKRMDESIDQALAMPVEEQQRRMKSMYQAIQRYDVQQWANHMFREAKATAVLGKEPTPV

SEQ ID NO: 1145 - protein, 629 aa, Pichia pastoris
MFVFEPVLLAVLVASTCVTAKTHTWNFTTGFVNANPDGVYERDDVIGLNGQWPLPVLEADKGDRIELYLTNGFEDYNTSLHFHGLFQNGTNSMDGPELITQCPIPPGETMLYNFTVDQVGAYWYHSHTAGQYGDGMRAAFIVHDGSDDDDFPYEYDEEFTFTISEWYHESSVDLIPNFMSRFNPTGAEPIPQNFLFNDTRNFTWNVEPSKTYKVNLINVGGFVSQYLWMEDHTFKVVQVDGVYTQPNETDMIYITVAQRYTVLIETKDDTSRNYALMQRVDDTMLDVIPKDLELNGTNYIVYNESAGLPEEYKVESLDIFLDDFWLEPLEAQEAYPDPDYQIVVDVAMDNLDDGVNYAFFNNLTYVAPKVPVLGTVFSAGEDAINPLVYGSNTNSFVLEKDEVIEIVLNNLDTGKHPFHLHGHVFQTVVRGPDYGEESTPVPYNASEAHDIPENPMRRDTVYVNPQSYFVIRFKADNPGVWFFHCHIEWHLDQGLALVLIEDPLSIQSQQNLDDNWKRMCEVNNMPYVGNAAANTENFLDLTDENVQVKNLPAGFTARGIVALVFSCIAGILGCVAIGLYGLAATDDNPVKLSQDLGIDEEFIQDETSSQLSHNGSKDTTEKTATELLN

SEQ ID NO: 1146 - protein, 532 aa, Coprinopsis cinerea okayama7#130
MTTRLLAYLQLGIALYHSGVRAQATLNPTDTMIISNAQVSPDGFARSAVVVNGVHPGPLLTGQKDDTFAINVVNELNDPTMLRSTSVHWHGLFQKGTNWADGAEGVNQCPISPASPENTENAFEYRFTPAGHAGTFWYHSHFGTQYCDGLRGPMVVYDPQDPYLGDYDVDNASTVITLADWFHTPAPSLRAPFRPDATLINGIGRTPGGEQVDLAVVNVEAGKKYRFRVVSLACDVNFQFSIDGHKLTIIEADGQLTDRLEVDRIQIFTGQRYSVILNANQEPGNYRIRAIPNAGVPGLVGTVDEGVNSAILRYAGAPIEEPSSDPPANPVDLREWELHAFSGPGFDPSAPGTPEIGAADVVLPLQFTFVGGKFQVNGVAYESPDVPTLLQIMSGRNPGELMPEGSVHYLPRNQVVEVQIPSGSISNSGPHPFHLHGHAFSVVRSAGNSTPNFVNPVKRDVVSIGGASDSVTIRFVTDNPGPWFFHCHIEPHLVDGLAIVFAEAMEDTVQANPLPEDREYCSVLHAFSGNLC

SEQ ID NO: 1147 - protein, 525 aa, Coprinopsis cinerea okayama7#130
MSRKLFSLAYLAVVLVSVAGQILGPTSTMTVSNIDASPDGFNRPVVAVNGQHPGPLVRANKGDNFRINVVNDLNDPTMLRQTSVHWHGVFQHGTAWADGPDGVTQCPIAQNGESFEYRFNAGNEAGTFWYHSHFGTQYCDGLRGPLVIYDPNDPHRNLYDVDNADTVITLVDWYHLQAPSIEGPALSDATLINGKGRRPGGPETDIAIVNVQRNRRYRFRLVSMSCDPNYKFSIDGHKLTVIEADGQLTEPLMVDEIQIFAGQRYSFVLSANRPVGNYWIRAIPNVGSNNLPNFSSGGINSAILRYAGAPNANPTSTPVTNPVALHESNLHALLNPGAPGGSGPADENIVLQMGLGPAGFEINGVTWANPDSPVMVQIMNGVPPADIVPSGAIHTLPRNRVVEVSIPGFELAGPHPFHLHGHAFSVVRSAGSSTYNYENPVRRDVVDVGGASDNVTIRFTTDNPGPWFFHCHIEFHLVLGLAMVFMEAPSDIPSTSPPPPSWSELCPKFESLPASATSIQIVPTP

SEQ ID NO: 1148 - protein, 1049 aa, Yarrowia lipolytica CLIB122
MTLIVVSLFLPYTINFNLDEGQRPKVDVTTEPVAPSRPPISRSNSDLKTLPTVPKSGGVSALTLALERFPQEKPSQQNSGGSSLTSSVTQTPNPALPSMFHKAEPTGPAPAIVHPDEFFKPSPHAQASAIVQPPSAVAGALQVSSAGSPQQAGFLENELALQKMKHPTVPPSASEPSSVSSANSNPAEYPTLRPPRPQYNQPQSRASSPPPRVVDKRRPVSGQTAMRFIDRFGQQKPSDSFQSAKDWTVEKSHKGNGGLRNAVNRYCASTNHKKLWVGTLGMPSDELGDVSKVEIERKLTREYDSVPVFAPDNTFEAHYTHYCKGILWPTLHYQTPDSDKSKAYHDHSWEHYKALNQMVADKVIEVYKRGDVIWIHDYHLLLVPEMVRQQLPNARIGMFLHVTFPSSEVFRCLAARNELLTGMLGATCIGFQTAEYGRHFLQTCNRLLVVDASVDGVENNDGRFTAVVACPIGIDPPSLQKHFMDPEVDKWRRLIRARWPGKRLLVSRDKLDSLRGIKQKLLAYEHFLINNREFCDNVVLVQVCLSGNESDSLEGELVHIMDRINALTDDLSNQQVIFLHQDIEFEQYLAMLAEAEAYVALSLREGMNLTCHEFILCSKDNSGQLILSEFTGSASVLDNDDVLVVNPWNMRQVSDAYKTALTMDRGTREKHRGRLVEFVEGHTCLQWATTFLQHLEDAWVEHQKSKRLLPRLNIAYAKERYDIVAKQPGKYRLFLLNLEGRDFSSPHTSKPALSSSAAVYSSTHNRIPILTELVSDPYNVVYIISSDARHDIERLFRNVPNLGIIAENGGYLRPYRSDQWIRMCDEEDVHNWKDSVLEVLESIKERCPGSSIKSDETTITFQFTPQYSAEQEQDFSFDFAGECVSHINDAFSTQNITARFNDDRILVENQQLSRLAAVKRAVAIFEKTCKIGGDIESKGINSGHLTVAPSSPTLTRTRSYTISAPGPSYDATISYVFVAGNDQSDYPVIEWANSLGDVETVLTVGLHSEHSPAAVSVEGLNGLTLALRELAVGDRSDIKGDRDTRERTP

SEQ ID NO: 1149 - protein, 624 aa, Candida albicans
MRTFLSSFIILTTFLASLIAAETHTWYFKTGWVDANPDGVYPRKMIGFNDSWPLPTLRVKKGDRVQLYLINGFDNLNTTLHFHGLFVRGANQMDGPEMVTQCPIPPGETYLYNFTVTDQVGTYWYHSHTGGQYGDGMRGVFIIEDDDFPYHYDEEVVLTLSDHYHKYSGDIGPAFLTRFNPTGAEPIPQNFLFNETRNATWKVEPGKTYFVRILNVGGFVSQYLWMEDHEFTIVEIDGVYVEKNTTDLIYITVAQRYGVLITTKNSTDKNYVFMNGVDTTMLDSVPADLQVNGTNYIVYNESSALPDAYDIDSYDDALDDFYLKPLSKQKLMDDADYTITVDVQMNVLNDGINYAFFNNISYKAPKVPTLLTVLSAGEAATNELIYGTNTNSFVLQGGDIVDIVLNNFDTGKHPFHLHGHVFQLIERHEAIGSKESAVTFNVSDHAEWPEYPMIRDTVYVKPHSYMVLRFKADNPVVWFFHCHVDWHLEQGLAVVLIEDPQAIQKNEKITENHKRICEKVGVPWEGNAAANSNDYLDLKGENVQVKRLPTGFTTKGIVALVFSCVAAFLGLFSFSFYGMNDIAHVEDKVARDLDIDLEAENEDEEEAVVLNQNSSSSDSNSKPH

SEQ ID NO: 1150 - protein, 533 aa, Coprinopsis cinerea okayama7#130
MLSNLLPLAILAVSLRPLIVPVTAQAIPPVATMTVSNINASPDGFTRPVVAVNGQHPPPPILANKGDDFQITVVNNLDDPTMLRQTSVHWHGIFVHKAAWADGPDGVTQCPIAQSGDSFTYSFDAGNEAGTFWYHSHYGTQYCDGLRGPLVIYDDNDPYKNLYDVDDESTIITLADWYHLPTPSIAGIALSDATLINGKGRRPGGPLTDIEIVNVQPGTRYRFRLISMACEPTYKFSIDGHNMTIIEADGQLTEPHTVQEITIFTGQRYSFILEANQPVGNYWIRAIPNLGARNLPDFSSGGINSAILRYAGARPRNPTTRAPRNPVVLKEANLRTLLNPGAPGGSGPADENIVFNLALNAEETGFVMNGVAWANPDIPVMVQLMNGVPAEDIIPQGAYRTLPRNSVVEVSIPGFEIAGPHPFHLHGHAFDVVRSAGSDTYNYVNPVRRDVVDIGGAGDNVTIRFRTDNPGPWFFHCHVEFHIITGLAMVFLEAPGDIASNSPPPPSWDALCPKFKSLPANATSIQIVPTPTP

SEQ ID NO: 1151 - protein, 855 aa, Oryza sativa Indica Group
MKQRLLVVANRLPVSANRRGEDQWSLEISAGGLVSALLGVKDVDAKWIGWAGVNVPDEVGQRALTRALAEKRCIPVFLDEEIVHQYYNGYCNNILWPLFHYLGLPQEDRLATTRNFESQFNAYKRANQMFADVVYQHYKEGDVIWCHDYHLMFLPKCLKDHDINMKVGWFLHTPFPSSEIYRTLPSRSELLRSVLCADLVGFHTYDYARHFVSACTRILGLEGTPEGVEDQGRLTRVAAFPIGIDSERFKRALELPAVKRHITELTQRFDGRKVMLGVDRLDMIKGIPQKILAFEKFLEENHEWNDKVVLLQIAVPTRTDVPEYQKLTSQVHEIVGRINGRFGTLTAVPIHHLDRSLDFHALCALYAVTDVALVTSLRDGMNLVSYEYVACQGSKKGVLILSEFAGAAQSLGAGAILVNPWNITEVADSIKHALTMSSDEREKRHRHNYAHVTTHTAQDWAETFVCELNETVAEAQLRTRQVPPDLPSQAAIQQYLHSKNRLLILGFNSTLTEPVESSGRRGGDQIKEMELKLHPELKGPLRALCEDEHTTVIVLSGSDRSVLDENFGEFNMWLAAEHGMFLRPTNGEWMTTMPEHLNMDWVDSVKNVFEYFTERTPRSHFEHRETSFVWNYKYADVEFGRLQARDMLQHLWTGPISNAAVDVVQGSRSVEVRSVGVTKGAAIDRILGEIVHSKSMITPIDYVLCIGHFLGKDEDIYVFFDPEYPSESKVKPDSSGSVSLDRRPNGRPSNGRSNSRNSQSRTPKAQAAPERSSSSSSSSQGTPNSHHDWREGSSVLDLKGENYFSCAVGRKRSNARYLLNSSEEVVSFLKEMADATAAHNGFQSTTADYMFLDRQ

SEQ ID NO: 1152 - protein, 185 aa, Triticum aestivum
  misc_feature (9)..(9): Xaa can be any naturally occurring amino acid
  misc_feature (30)..(30): Xaa can be any naturally occurring amino acid
  misc_feature (36)..(36): Xaa can be any naturally occurring amino acid
  misc_feature (49)..(49): Xaa can be any naturally occurring amino acid
  misc_feature (89)..(89): Xaa can be any naturally occurring amino acid
SRGYMGECXKEGGTMEILGSSAPVREQIYXIASVNXCSNITGQILASLXMNPPKASDESYASYKAEKDGILASLARRAKALEVAFSKLXGITCNKAEGAMYLFPQICLPQRAIEAAKAANKAPDAFYALRLLESTGIVVAPGSGFGQVPGTWHFRCTILPQEEKIPAIISRFTVFHETFMAEYRD

SEQ ID NO: 1153 - protein, 546 aa, Coprinopsis cinerea okayama7#130
MSTRLVAYLQLAISLYQSVARGQAVLNPSDTMVISNANVSPDGVPRSAVVVNGVHPGPVLVGQKDDNFAINVVNELTDPTMLRSTSVHWHGLFQRGTNWADGAEGVNQCPIAPERSFLYRFSPAGHAGTFWYHSHFGTQYCDGLRGPMVVYDPEDPYKDEYDVDDVNTIITLADWYHTPAPSIRGAFRPDATLINGLGRTPGGPPVDLAVVNVQEGQKYRFRIVSLACDVNFQFSIDGHKLTVIEADGQLTDPLEVDRIQIFTGQRYSVILHANQAPNNYRIRAIPNAGVAGLTGTVDGGVNSAILRYAGAPVAEPTTEAPSNMIDLSESQLHAYAGGDPAAPGRPEAGGADVTIPLRFTFSGGRFFVNGTSYTSPSVPTLLQIMNGANPGELLPENSVYYLPRNQVVEVEIPSTGISGSGPHPFHLHGHAFSVVRSAGNSSYNYVNPVKRDVVSMGGDSDLVTIRFVTDNPGPWFFHCHIEPHLVGGLAIVFAEAMEDTAAAHPDIPTEWRDLCDIHHDLDPSLTSVSIVRRAEPTGLSAKFRGL

SEQ ID NO: 1154 - protein, 388 aa, Agrobacterium tumefaciens str. C58
MSILNSLSARSLAAPESGIVEVVNYARGRDNLLPLWVGEGDLPSPDFINQAAIDGLNNGETFYTWQRGIPELRQALSHYYERHFAASLPPEHFYATGSGMQAIVLAVQALTSPGDEMVYLSPTWPNIVAAIGVAGAKAVPVGIDFRDGRWDLDINRLESAITGKTKALFINTPSNPTGWTATRDNLRDVLALARKHDLWIVADEIYALYHYAGSRAPSFLDVMEPDDKIVFANSFSKNWSMTGWRVGWLVAPPAIGQVIENLIQYSTSGVAQFMQRGAVAALDHGDGFIRENYERALTSRDILCDALIATNRVETLKPDGALYAFLKIDGVTDSRATALDIVDKTGVGLAPGTAFGPGGELFLRACFLRNPRQIEDAADRLASYILGR

SEQ ID NO: 1155 - protein, 517 aa, Coprinopsis cinerea okayama7#130
MILLTFSLLILLSLPAALAGFGSSGDLIVGNRFISPDGFSRSAVLAGSSVSGLTFPGPIITGTRGGRFHLNVVNELIDPAMLRTTSIHWHGLFQRGSQWADGPAGVTQCPIVPGSSFLYQFQVPDQAGTFWYHSHHQTQYCDGLRGAFVLYDPHDPHHQLYDIDDESTIITLADWYHTPTLSAGALPIFNSTLINGKGRFAGGPPVDLAVIHVERNRRYRFRLISMSCDPNYIFSIDGHTLTVIEVDGVNVQPHTVDSIQIFAAQRVSFVLNANRPIDNYWIRADPNFGNTGFAGGINSAVLRYHGAEPADPVTERLPFSSPFREFDLRPLFPEPVPGRPEVGGADININLEIGFDSQSTRFSVNNATMIQPTVPVLLQILSGARTPQELMPPGSIYTLPRNRVVELSIPGGSAGSPHPVHFHGHTFHVIRSAGSSEYNYFDPIQRDVVSIGEATDNVTIRFVTDNAGPWILHCHIDFHRALGFAVVFAEDAERVAALEPPPAWHELCPKYEAFGEQ

SEQ ID NO: 1156 - protein, 599 aa, Thanatephorus cucumeris
MARSTTSLFALSLVASAFARVVDYGFDVANGAVAPDGVTRNAVLVNGRFPGPLITANKGDTLKITVRNKLSDPTMRRSTTIHWHGLLQHRTAEEDGPAFVTQCPIPPQESYTYTMPLGEQTGTYWYHSHLSSQYVDGLRGPIVIYDPHDPYRNYYDVDDERTVFTLADWYHTPSEAIIATHDVLKTIPDSGTINGKGKYDPASANTNNTTLENLYTLKVKRGKRYRLRIINASAIASFRFGVQGHKCTIIEADGVLTKPIEVDAFDILAGQRYSCILKADQDPDSYWINAPITNVLNTNVQALLVYEDDKRPTHYPWKPFLTWKISNEIIQYWQHKHGSHGHKGKGHHHKVRAIGGVSGLSSRVKSRASDLSKKAVELAAALVAGEAELDKRQNEDNSTIVLDETKLIALVQPGAPGGSRPADVVVPLDFGLNFANGLWTINNVSYSPPDVPTLLKILTDKDKVDASDFTADEHTYILPKNQVVELHIKGQALGIVHPLHLHGHAFDVVQFGDNAPNYVNPPRRDVVGVTDAGVRIQFRTDNPGPWFLHCHIDWHLEEGFAMVFAEAPEDIKKGSQSVKPDGQWKKLCEKYEKLPEALQ

SEQ ID NO: 1157 - protein, 851 aa, Arabidopsis thaliana
MISRSYTNLLDLASGNFPVMGRERRRLPRVMTVPGNVSEFDEDQAYSVSSDNPSSVSSDRMIIVANRLPLKAEKRNGSWSFSWDQDSLYLQLKDGLPEDMEILYVGSLSVDVDSNEQDDVAQILLDKFKCVPTFFPPDLQSKFYDGFCKRQIWPLFHYMLPFSADHGGRFDRSLWEAYVATNKLFFQKVIEVINPDDDFVWIHDYHLMVLPTFLRRRFNRIRMGFFLHSPFPSSEIYRSLPVREEILKALLNSDLIGFHTFDYARHFLTCCSRMLGLEYQSKRGYIGLEYYGRTVGIKIMPVGINMGRIQSVMRYSEEEGKVMELRNRFEGKTVLLGIDDMDIFKGINLKLLAMEQMLRQHPNWRGRAVLVQIVNPARGKGIDVEEIRGEIEESCRRINGEFGKPGYQPIIYIDTPVSINEINAYYHIAECVVVTAVRDGMNLTPYEYIVCRQGLLGSESDFSGPKKSMLVASEFIGCSPSLSGAIRVNPWNVEATGEALNEALSMSDAEKQLRHEKHFRYVSTHDVAYWSRSFLQDLERICVDHFKKRCWGMGISFGFRVVALDPNFRKLSIPCIVSDYKRAKSRAILLDYDGTLMPQNSINKAPSQEVLNFLDALCEDKKNSIFIVSGRGRESLSKWFTPCKKIGIAAEHGYFLKWSGSEEWETCGQSSDFGWMQIVEPVMKQYTESTDGSSIEIKESALVWQYRDADPGFGSLQAKEMLEHLESVLANEPVAVKSGHYIVEVKPQGVSKGSVSEKIFSSMAGKGKPVDFVLCIGDDRSDEDMFEAIGNAMSKRLLCDNALVFACTVGQKPSKAKYYLDDTTEVTCMLESLAEASEASNFSMRELDEAL

SEQ ID NO: 1158 - protein, 518 aa, Rigidoporus microporus
MFRFNTFSTLIPLALSLGVRAAIGPVADLHISNANISPDGFTRAAVLAGGSFPGPLITGNKGDNFQINVINDLTDADQLKTTTIHWHGFFQHGTNWADGPAFINQCPIASGNSFLYNFQVPDQAGTFWYHSHLSTQYCDGLRGAFVVYDPDDPHASLYDVGDESTVIALADWYHGLARLGPKFPTTNSTLINGLGRYDFGPSSDLAVISVQAGKRYRFRLVSISCDSNYVFSIDEHTFTVIEVDGVNHQPVDADSLQIFAGQRYSIVVNADKSEGGNYWIRASPTPGPQGFANGINSAILRYVGSDEVEPTTNQTTSTNPLVEANLVPLENPGAPGDPTPGGVDVPLNLAVAFDGTGLDFQVNGQTFIPPTVPVLLQILSGAQSATDLLPSGSVYVLPSNATVEISIPAGAVGGPHPIHLHGHTFDVVRSAGSSTYNYVNPPRRDVVSIGNAGDNVTIRFRTDNPGPWFLHCHIDWHLEAGFAVVFAEDIPNVASVNSPPQAWSDLCPIYDALDPSDH

SEQ ID NO: 1159 - protein, 456 aa, Escherichia coli
  misc_feature (345)..(345): Xaa can be any naturally occurring amino acid
  misc_feature (363)..(363): Xaa can be any naturally occurring amino acid
  misc_feature (418)..(418): Xaa can be any naturally occurring amino acid
  misc_feature (430)..(430): Xaa can be any naturally occurring amino acid
SRLVVVSNRIAPPDEHAASAGGLAVGILGALKAAGGLWFGWSGETGNEDQPLKKVKKGNITWASFNLSEQDLDEYYNQFSNAVLWPAFHYRLDLVQFQRPAWDGYLRVNALLADKLLPLLQDDDIIWIHDYHLLPFAHELRKRGVNNRIGFFLHIPFPTPEIFNALPTYDTLLEQLCDYDLLGFQTENDRLAFLDCLSNLTRVTTRSAKSHTAWGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLXKIFRYSDVGLVTPLRDGXNLVAKEYVAAQDPANPGVLVLSQFAGAANELTSALIVNPYDRDEVAAALDRALTXSLAERISRHAEXLDVIVKNDINHWQECFISDLKQIVPR

SEQ ID NO: 1160 - protein, 328 aa, Zea mays
RTLSLRLKVKIIRYAPCGEIVKHASVPYNLTEDNGWGLEIFEVKRCLEEARSAGLTVRAMVVINPGNPTGQVLSVTNQEEIVEFCRKEGLVILADEVYQENIYAENKKFHSFKKVARSLAYDENDLTLVSLHSVSMSYGESGRRGGYMEVSGVAANVKDQIYKVASLTLCPNIAGQILVSLAMDPPKLGDESFESFDKEKEQIRSSFCKRAKTLEKAFSGLEGVTCNKLEGALYLFPRLHLPSAAIRAADFEGVSPDIFYAHRLLDATGIAVVPGSGFHQASGTIHIRCTILPDERKIEAMVARLRAFHKAFMNEFRGSQQVMNDLRR

SEQ ID NO: 1161 - protein, 501 aa, Nocardia farcinica IFM 10152
MRTGANAPQGAGSGFVVVANRLPVDLERLPDGSTRWKRSPGGLVTALEPVLRNNKGAWVGWAGVPDVDVDPIIEDGLELHPVPLSAQEVADYYEGFSNGTLWPLYHDVIVRPTYDRAWWAAYVQVNRRFAEETAKVAAEGATVWVQDYQLQLVPKMLRMLRPDLTIGFFLHIPFPPVELFMQMPWRTEIIEGLLGADLIGFHLPGGAQNFLYLARRLAGQPTSRGTVGVRSKLGVVQVGFRTVRVGAFPISIASAELDEQSRRRSIRERAAKIRAELGNPKNILLGVDRLDYTKGIDIRLNALEELLVEGRFDPAETVMVQLATPSRERVESYIQMRGDIERQVGRINGEFARVGYPVVHYLHRPIPRDELLAFFVAADVMLVTPLRDGMNLVAKEYVACHSGLNGALVLSEFTGAAAELRQAYLCNPHDLDSVKDAIVSALEDDRETKRRRMRSLRRQVLAHDVDRWARAFLDALAQDQVAGSALITENDDYGDNDAPSR

SEQ ID NO: 1162 - protein, 495 aa, Saccharomyces cerevisiae
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 1163 - protein, 404 aa, Shewanella sp. MR-7
MRPIIKSNKLDTVCYDIRGPVHKEARRLEDEGHRILKLNIGNPAPFGFEAPEEIVRDVILNLPSAQGYCESKGLFSARKAIVQHYQAQGIFGVDIEDIYIGNGVSELIMMAMQGLLNTDDEILIPSPDYPLWTAAANLAGGKAVHYRCDEDADWFPDLDDIKSKISSRTRGIVLINPNNPTGAVYSKELLLQVVELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLREKKILLVHGSAFNWPEPDHLRVVFLPYKEDLTKALTEFGHFLETYKQ

SEQ ID NO: 1164 - protein, 491 aa, Nicotiana tabacum
MGFENEKNSSILSKLATNEELGENSPYFDGWKAYDNDPFHPLKNPNGVIQMGLAENQLCFDLIEEWIKRNPNASICTTEGIKSFRAIANFQDYHGLPEFRSAIAKFMEKTRGGRVTFDPERVVMAGGATGANETIIFCLADTGDAFLVPSPYYPAFNRDLRWRTGVQLIPIPCDSSNNFQITTKAVREAYENAQKSNIKVKGLILTNPSNPLGTTLDRDTLKNLLTFTNQHNIHLVCDEIYAATVFNTPQFVSIAEILDDETSHCNKDLVHIVYSLSKDMGLPGFRVGIVYSFNDAVVNCARKMSSFGLVSTQTQYLLAEMLSDERFVSNFLTESSKRLAKRHKHFTNGLEEVGIKCLRSNAGLFCWMDLRPLLKESTFDSEMSLWRVIINDVKLNVSPGSSFDCQEPGFFRVCFANMDDETVDIALARIRSFVGVKKSGDESTPILMEKKQQWKKNNLRLSFSKRMYDESVNLSPLSSPIPHSPLVRART

SEQ ID NO: 1165 - protein, 436 aa, Photorhabdus temperata
MHLQNTWREEYIKCQTLYARHPLFTKIKVRLSMLAVKKSSKLDNVCYDIRGPVLKEAKRLEEEGNKVLKLNIGNPAPFGFEAPDEILVDVIRNLPTAQGYSDSKGLYSARKAIMQHYQARNMLDVSVEDIYIGNGVSELIVQAMQALLNTGDEMLVPAPDYPLWTAAVSLSSGKAVHYMCDEGSDWFPDLDDIRNKITPRTRGIVIINPNNPTGAVYSKALLLEIVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHFRIVTLPRLDELEMAIQKFARFIGKYHQ

SEQ ID NO: 1166 - protein, 424 aa, Xylella fastidiosa Ann-1
MSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVADKVVPLKSRSAAA

SEQ ID NO: 1167 - protein, 404 aa, Vibrio cholerae O1 biovar eltor str. N16961
MQNIGMSSKLDNVCYDIRGPVLKHAKRMEEEGHKILKLNIGNPAPFGFDAPDEILVDVIRNLPTSQGYCDSKGIYSARKAVVQYYQKKGIRSLDVEDVYIGNGASELIVMAMQALLNNGDEMLVPAPDYPLWTAAVALSGGKAVHYICDEEADWYPDLDDIRSKITPKTRGIVLINPNNPTGAVYSRDFLLEIIEIARKHKLMIFADEIYDKVLYDGAVHTSIATLADDVLVVTFNGLSKAYRVCGFRGGWMFLTGPKQQAQGYIAGLDMLASMRLCANVPMQHAIQTALGGYQSINELILPGGRLLEQRDRAWELINQIPGISCVKPKGAMYLFPKIDTKMYPIKDDQKMVLDFLVQEKVLLVQGSGFNWPKPDHFRIVTLPHVEDLEIAISRFERFITTYSQ

SEQ ID NO: 1168 - protein, 519 aa, Trametes versicolor
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTTSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 1169 - protein, 572 aa, Thanatephorus cucumeris
MARTTFLVSVSLFVSAVLARTVEYNLKISNGKIAPDGVERDATLVNGGYPGPLIFANKGDTLKVKVQNKLTNPDMYRTTSIHWHGLLQHRNADDDGPAFVTQCPIVPQASYTYTMPLGDQTGTYWYHSHLSSQYVDGLRGPLVIYDPKDPHRRLYDIDDEKTVLIIGDWYHTSSKAILATGNITLQQPDSATINGKGRFDPDNTPANPNTLYTLKVKRGKRYRLRVINSSAIASFRMSIQGHKMTVIAADGVSTKPYQVDSFDILAGQRIDAVVEANQEPDTYWINAPLTNVANKTAQALLIYEDDRRPYHPPKGPYRKWSVSEAIIKYWKHKHGRGLLSGHGGLKARMMEGSLHLHGRRDIVKRQNETTTVVMDETKLVPLEHPGAACGSKPADLVIDLTFGVNFTTGHWMINGIPHKSPDMPTLLKILTDTDGVTESDFTQPEHTIILPKNKCVEFNIKGNSGLGIVHPIHLHGHTFDVVQFGNNPPNYVNPPRRDVVGATDEGVRFQFKTDNPGPWFLHCHIDWHLEEGFAMVFAEAPEAIKGGPKSVPVDRQWKDLCRKYGSLPAGFL

SEQ ID NO: 1170 - protein, 531 aa, Thanatephorus cucumeris
MLSSITLLPLLAAVSTPAFAAVRNYKFDIKNVNVAPDGFQRPIVSVNGLVPGTLITANKGDTLRINVTNQLTDPSMRRATTIHWHGLFQATTADEDGPAFVTQCPIAQNLSYTYEIPLHGQTGTMWYHAHLASQYVDGLRGPLVIYDPNDPHKSRYDVDDASTVVMLEDWYHTPAPVLEKQMFSTNNTALLSPVPDSGLINGKGRYVGGPAVPRSVINVKRGKRYRLRVINASAIGSFTFSIEGHRLTVIEADGIPHQPLPVDSFQIYAGQRYSVIVEANQTAANYWIRAPMTVAGAGTNANLDPTNVFAVLHYEGAPNAEPTTEQGSAIGTALVEENLHALINPGAPGGSAPADVSLNLAIGRSTVDGILRFTFNNIKYEAPSLPTLLKILANNASNDADFTPNEHTIVLPHNKVIGAQHHRGADHPIHLHGHVFDIVKSLGGTPNYVNPPRRDVVRVGGTGVVLRFKADNPGPWFVHCHIDCTWRLGSHLSLPRPPARFARVSSRSSPTMPGTSSAPSTRLFLPICSKW

SEQ ID NO: 1171 - protein, 411 aa, Colwellia psychrerythraea 34H
MKAITKSSKLHNVCYDIRGQVAVEAKRLEDEGHKILKLNIGNPAPFGFEAPDDILKDVIHNLPNSQGYSESQGIYSARVAVMQYFQQQGIKDVMVDDIFIGNGVSELIVMAMQALLDNGDEVLIPAPDYPLWTAAVSLSGGKPVHYRCDEQNHWFPDLEDMESKITKKTKAIVLINPNNPTGAVYSEEVLHAIIALARKHGLIIYSDEIYDKILYDEAKHVPTAALATDVFIITLGGLSKNYRIAGFRAGWMVISGPKLHAEDYIKGIKLLSSMRMCANVPSQHAIQTALGGYQSINELIRDDGRLIKQRNVAYKMINDIDGLSCNPAMGALYLFVKVDNKKFNITNDERMVLDLLKQEKILLVHGRAFNVKEHNYFRLVFLPHVDELIPALEKLKSFFASYKQVQPSKSA

SEQ ID NO: 1172 - protein, 393 aa, Rubrobacter xylanophilus DSM 9941
MRLAGRMRRLGTESAFAVLARARELEAQGRDIIHLEIGEPDFDTPPHIVEAGCRALREGHTHYTPAAGIPELREAIAEEVSRSRGVPVHPSQVVVTPGGKPVMFFAILVLVEPGDEVLLPNPAFPIYESMVNFVGGRPVFVPLRQENGFRFDPEEFGERLGPKTRLVILNSPANPTGGVLTPEDTRALAEILRERPDVYVLSDEIYSRLVYPEASFASIASEPGLGPDGRTIILDGFSKTYAMTGWRLGYGVMPRRLAGEFAKLQVNSSSCANAAAQRAGLAALEGPQEPVEEMVREFGARRDMIVAGLNELPGVECRTPHGAFYAFPRVTGTGRSAGELARLLLEEAGVACLSGDGFGRYGEGHLRFSYANSRENISRALERVAKTLAGAAR

SEQ ID NO: 1173 - protein, 459 aa, Erythrobacter sp. NAP1
MVISNRVAVPKARGVAGAQGGLAGALNAALKDRGGVWFGWSGQESEDRTGNMDLQRNDGVTTATIDLSTRDVGEYYNGYANSTLWPLFHYRIDLARFENRTGEGYERVNDRFAESALPLIEEDDLVWVHDYHLIPLGERLRSRGIKNRIGFFLHTPWPPTRLLTSLPFHERLVRTMLSYDLIGFQTKEWLSSFVHYCETELGAKVDHDTGRITHEGRTTTARAYPIGIDWKHFQAQGDTGEARNASQRLLASTRHRTAMIGVDRLDYSKGLPERIDGIGRFFDEHPERTRDLVFIQIAPPSREDVESYQQIRGLLEQKTGQINGARSEVDIVPIRYVNRGYTHAQLFGFFRAAKIGLVTPLRDGMNLVAKEYVAAQDPEDPGVLVLSEFAGAAHQLGCDGKGAVLVNPHSPDALAGAIRKALDMPLEERKSRYEAMIATVRDDDVRDWTQNFCTDLAAD

SEQ ID NO: 1174 - protein, 1054 aa, Saccharomyces cerevisiae YJM789
MTIIVASLFLPYTPQFEADVTNSDTAKLVESSMIKVDCNNQELSNNKQERSSSVTSASSHYIGLPQEAQINGEPLQRANVGSPATGVNYHNEMEMLSSEQFLEELTANATHAANSGIPPANNPVSSGSTAQRPSVEEFFSAPSARVCSPSQEASASSISASRSSAHHNDLSSSLMKNPNLSFDSHPPRVRSSSKSAVITPVSKSVPDVDPAVVDVAKVREEFQQQASLPSMKRVSGSTAGDSSIASSSSNLRYSQQFQDNFIEDTDSEDDIDSDLETDATKKYNVPKFGGYSNNAKLRASLMRNSYELFKHLPWTIVDSDKGNGSLKNAVNIAVAEKTVKEPVSWVGTMGIPTDELPHDVCHKISKKLEQDFSSFPVVTDDITFKGAYKNYAKQILWPTLHYQIPDNPNSKAFEDHSWDYYQKVNQKFSDRIVSVYKPGDTIWIHDYHLMLVPQMVREKLPKAKIGFFLHVSFPSSEVFRCLANRERILEGIIGANFVGFQTKEYKRHFLQTCNRLLAADVSNDEVKYHCNIVSVMYAPIGIDYYHLTSQLRNGSVLEWRQLIKERWRNKKLIVCRDQFDRIRGLQKKMLAYERFLIENPEYIEKVVLIQICIGKSSDPEYERQIMVVVDRINSLSSNISISQPVVFLHQDLDFAQYLALNCEADVFLVDALREGMNLTCHEFIVSSFEKNAPLLLSEFTGSSSVLKEGAILINPWDINHVAQSIKRSLEMSPEEKRRRWKKLFKSVIEHDSDNWITKCFEYINNAWESNQETSTVFNLAPEKFCADYKASKKHLFIFKISEPPTSRMLSLLSELSSNNIVYVLSSFTKNTFEGLYNGVLNIGLIAENGAYVRVNGSWYNIVEELDWMKEVAKIFDEKVERLPGSYYKIADSMIRFHTENAEDQDRVPTVIGEAITHINTLFDDRDIHAYVHKDIVFVQQTGLALAAAEFLMKFYNSGVSPTDNSRISLSRTSSSMSVGNNKKHFQNQVDFVCVSGSTSPIIEPLFKLVKQEVEKNNLKFGYTILYGSSRSTYAKEHINGVNELFTILHDLTAA

SEQ ID NO: 1175 - protein, 113 aa, Triticum aestivum
GMTCNKAEGAMYLFPRLHLPQKAIGAAQAAGAAPDAYYALRLLQATGIVVVPGSGFGQAPGTYHFRCTILPQEDKIPAIISRFKEFHEKFMDEFRDVSRDEAPTGTTIESGGD

SEQ ID NO: 1176 - protein, 591 aa, Cryphonectria parasitica
MPSFFRALFSGLIASQLSWAAPSLLHPLEPRQQPNCNTASNRACWISGSYDITTDYEVKTPLTGVVRQYDLTLTQAENWLGPDGVVKEDVMLVNGNILGPVIHAQWGDTISVTVTNNLKYNGTTIHWHGIRQLNTNLQDGVNGITECPIPPNGGSKTYTFIAHQYGTSWYHSHFSAQYGNGIVGAIQIDGPASLPYDIDLGPLVLSDYYYKTADELVVYTQSNAPPASDNVLFNGTNINPANTTQGQYKTITLTPGKRHRLRIINTSVENNFQVSIVGHSMTVIESDFVPVDSFTTDSLFVGIGQRYDVTIDASQATDNYWMNVTFGGGGFCGKSNNPYPAAIIHYNGASNSHPTNKGVAPADHECLDLLNLVPVVPRSIPTSGFVAASDNTLDVQLSTTTRKWTINGSTLDVDWGHPITQYVINKSTAWPSTDNVWLVEEANQWAYWLIENDPTATGNALPHPIHLHGHDFVVLGRSPNVSPTAQTPYTFTSSDVSSLNGNNPIRRDVVMLPPKGWLLIAFQTTNPGAWLMHCHIAWHVSAGLGNTFLEQPSAFVAGLNTNDVNQLNSQCKSWNAYYPSKDIFKQDDSGV

SEQ ID NO: 1177 - protein, 857 aa, Solanum tuberosum
MMSRSYTNLLDLASGNFPVMGRERDRRRMSRVMTVPGSICELDDDQAVSVSSDNQSSLAGDRMIVVANQLPLKAKRRPDNKGWSFSWNEDSLLLRLKDGLPEDMEVLFVGSLSVDVDPIEQDDVSSYLLDKFRCVPTFLPPNIVEKYYEGFCKRHLWPLFHYMLPFSPDHGGRFDRSMWEAYVSANKMFSQKVVEVLNPEDDFVWIHDYHLMVLPTFLRRRFNRLRIGFFLHSPFPSSEIYRTLPVREEILKALLCSDLVGFHTFDYARHFLSCCSRMLGLEYQSKRGYIGLEYYGRTVGIKIMPVGIHMGHIESMKKIADKELKFKELKQQFEGKTVLLGVDDLDIFKGINLKLLAMEHMLKQHPSWQGQAVLVQIANPMRGKGIDLEEIQAEIQESCKRINKQFGKPGYEPIVYIDRSVSSSERMAYYSVAECVVVTAVRDGMNLTPYEYIVCRQGVSGAETDSGVGEPDKSMLVVSEFIGCSPSLSGAIRINPWNVEATAEAMNEAVSMAEQEKQLRHEKHYRYVSTHDVAYWSRSFLQDMERTCADHFRKRCYGIGLGFGFRVVSLDPNFRKLSIDDIVNAYIKSKSRAIFLDYDGTVMPQNSIIKSPSANVISILNKLSGDPNNTVFIVSGRGRESLTKWFSPCRKLGLAAEHGYFLRWEREQKWEVCSQTSDFGWMQLAEPVMQSYTDATDGSCIERKESAIVWQYRDADSGFGFSQAKEMLDHLESVLANEPVAVKSGQHIVEVKPQGVTKGLVAEKVFTSLAVKGKLADFVLCIGDDRSDEDMFEIIGDALSRNIISYDAKVFACTVGQKPSKAKYYLDDTSEVVLMLDSLADATDTPVTSDDEPVDSD

SEQ ID NO: 1178 - protein, 405 aa, Klebsiella pneumoniae subsp. pneumoniae MGH 78578
MSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLQEIVEIARQHNLIIFADEIYDKILYDEAQHHSIAALAPDLLTVTFNGLSKTYRVAGFRQGWMVLNGPKKHAKGYIEGLEMLASMRLCANVPAQHAIQTALGGYQSISEFIIPGGRLYEQRNRAWELINDIPGVSCVKPKGALYMFPKIDAKRFNIHDDQKMVLDFLLQEKVLLVQGTAFNWPWPDHVRIVTLPREDDLEMAISRFGRFLSGYHQL

SEQ ID NO: 1179 - protein, 497 aa, Synechococcus sp. RS9916
MTKEEGKSSFILLYHRTPFDEIIDEQGNRSWGDQKSPNGIIPTLRNLFRSHLNGTWIAWRQVEENDTSGDERIAMEEPAPFTLRRIPLEHYQISSFYHVTSKESIWPILHTFPNYFDVNNADWGIFEEVNRRFAEAACREAAKAATVWVHDYNLWLAPGYIRAERPDLKIAFFHHTPFPGNDVFAILPWRREILESLLCCDLVGFHIPRYTENFARAANCLLGAKKGPKRGVNARFLSTGSALTEPSETPWLTYEGRTIQLLSSPVGTSPDVIQDLVSDPEIQALGERIEEDTRKGRKLILSASRVDYTKGNEELLLAFERLLERRADLHGEVVLMLACVSAANGMKIYEDTQRSIEEMAGRINGRFSKMDWVPVRFSTRRIPYEEMVAWFTHADVCWITPLRDGLNLVAKEYAAARKDKSGVLVLSEFTGASVVLDGAVLTNPYSHRRMDEAIELALSMPENEQKRRMRTMTTAVESFTVQDWAEEQMGSLDSFLA

SEQ ID NO: 1180 - protein, 452 aa, Oryza sativa Japonica Group
MSYNHSPSITAETINQKVRIFTYEPCGEIVRHARIIYCNLGNPQALGQRPINFFREVLSLCDNPSLIDRDEARALFSPCALKRARKIIESLPGRDSGSYTSSQGVRGLREAVADGIAARDGFPSKPDNIFLTDGASSAINMMMQILIRSHEDGILCPLPEYPLYSASIILHGGTMVPYNLTEDSIWGLEIFEVKRCLEDARASGLTIRAMVVINPGNPTGQVLSITNQEEIVEFCRKEGLVILADEVYQENVYTENKRFNSFKKVARSLGYDHHDLSIVSFHSVSMGYYGECGRRGGYMEICGFGDDVIDEMYKLASLTICPNIAGQILISLVMDPPKALQKAFNGLEGVSCNKFEGAMYLFPRLRLPQAAIKAAQLEGVSPDVFYAHRLLDATGIAVVPGSGFHPDLVSSCKKVSGTSHIRCTILPGEETITAMVPSLQAFHEAFMDEFRG

SEQ ID NO: 1181 - protein, 173 aa, Alteromonadales bacterium TW-7
MQIGLFFGSTTCYTEMAAEKIRDLIGDDIVSLHNIKDEPLKNAEQYDFIIFGISTWDFGEIQEDWESKWDDIKDVNLNGKTIALFGMGDQQGYGQWFQDALGMLHDEINTQTFTQLGFWPNDSSYEFEASKALTPDGKQFVGLALDEDSQYELSDERIASWVEQVMTEYGETL

SEQ ID NO: 1182 - protein, 175 aa, Vibrio fischeri ES114
MASVGLFFGSDTGNTEAVGKMIQKQLGKKLVHVQDIAKSSKEDIDNFDLLLLGIPTWYYGEAQCDWDDFFPELEEIDFSTKLVAIFGCGDQEDYAEYFCDAMGNIRDIVEAKGGTIIGYWPTEGYEFEASKALVDDDNFVGLCIDEDRQPELTEERVTKWVNQIHEEMCLAELED

SEQ ID NO: 1183 - protein, 422 aa, Vitis vinifera
METGTKKWGFEDAENGPDTTTTITIKGLISLLMANIDEGNNKRLISLGMGDPSVYTCFHTSHVATESVVDAVESNKYNGYAPTSGLPQARKAIAEYLSRDLPYKLSLDDVFITSGCTQAIDVALSILARPGANILIPNPGFPIYQLSASFRGLEVRYYDLLPEKGWEADLDAIKALADQNTVALVIINPNNPCGSVYSYQHLKKTAETARKLSIPVIADEVYGHLAFGGNPFVPMGVFGSIVPVLTLGSLSKRWIVPGWRLGWFVITDPSCLFITPKIVERLKKYFDILGGPATFIQAAVPRIMEQTDGTFFKKTINILKQASDICLEKIQEIPCITCPHKPEGSMAVMVKLNLSLLEDINDDIDFCFKLAKEESVIILPGVAVGLKNWLRITFAADPSFLEEGLERIKSFYHRHSNIQHSN

SEQ ID NO: 1184 - protein, 513 aa, Cyathus bulleri
MFKTLYIFTLLSIAYGAIGPVLDMHIVNKVISPDGFNRSAVLAGGTADNADFPGPLVTGNKGDHFQLNVIDSLTDTTMLRGTSIHWHGLFQHGTTWADGPVGVNQCPISPGNSFLYDFSVPDQAGTFWYHSHHSTQYCDGLRGPLVVYDPNDPHKSLYDVDDESTVITLADWYHTPAPSAGLVPTTDAVLINGKGRFPTGPTSPLSVINVTPGTKYRFRLVSISCDPNFVFSIDGHTFTIIEVDGVNVTPVEVDSIQIFAGQRYSFVLNANQPVDNYWIRAKPNIAKGVTFDGGINSAILRYAGAPDTDPTTSQTPNSAPMVETDLHPLENPGAPGGSNPADVPLNLAIAFGSNLKFTVNGATFAPPNVPVLLQILSGAQTAQDLLPTGSVYTLPANKVIEISIPGGTTGFPHPFHLHGHTFDVVRSAGSSVYNYDNPVRRDAVNTGGAGDNVTIRFLTDNAGPWILHCHIDWHLELGLAIVFAEDVPTIAASNPPDAWDNLCPAYATQPTGT

SEQ ID NO: 1185 - protein, 483 aa, Oryza sativa Japonica Group; identical to SEQ ID NO: 270

SEQ ID NO: 1186 - protein, 379 aa, Oryza sativa Japonica Group
ASFLEKQLEDTVTGIEGLRDAIAAGIASRDGLPSYSEDIFLTDGAAAPVHMMMHLLIRGKKDGILCPIPSHSLYTDSMVLRGATLVPYYLDESRGWSVNISDLKKQLDGARAKGIDVRGLVVVNPGNPTGQVLVEENQCEIVELCKNECLVLLADEVYQENIYTDQKKFNSFKKVARSIGYGEGDISLVSFHSVSNGYYGECGRRGGYMEVTGFSSEVRGEVYKVASLSACSNISGQILMSLVMNPPKVGDESYPSYRAERDSILSSLSCCAEAMVSTFNSMEGMTCNKAEGGISVFPSVRLPPRAIEAAEAMNTEPDVFYALRLLESTGIVVVPGSVFGQVPGTWHFRCTILPQEEKTRQIISRFNVFHEAFMEEFRS

SEQ ID NO: 1187 - protein, 406 aa, Pseudoalteromonas tunicata D2
MPIIKKSNKLEGVCYDIRGPVLKQARRMEDEGQKVLKLNIGNPAAFGFDMPEDMHKDIIRNLSSAQGYCDAKGLYSARVAIYQHYQQKNFFNLDVDNIYIGNGVSELIQLSTQALLNDGDEVLIPAPDYPLWTAAVRLASGTPVHYLCDEQQDWFPDINDIRSKITSKTKAIVLINPNNPTGAVYDVAMIQDLIGVAREHKLLIFSDEIYEKILYDGVTFTSVGSLCDDLPIITFNGLAKTYRAAGLRMGWMVLSGKLASMHDYIQGLDMLASMRLCANVPAQYAIQQALGGVQSIDDLIRPTGRLYQQRDIVYQGLNAIDGISCVKPKGALYAFAKFDRAKFNVHDDEKLIYDLLMQEKILLVHGRAFNWPEPDHFRLVFLPHQDQLKPALAQMARFFDNYKQDR

SEQ ID NO: 1188 - protein, 576 aa, Thanatephorus cucumeris
MARTTFLVSVSLFVSAVLARTVEYGLKISDGEIAPDGVKRNATLVNGGYPGPLIFANKGDTLKVKVQNKLTNPEMYRTTSIHWHGLLQHRNADDDGPSFVTQCPIVPRESYTYTIPLDDQTGTYWYHSHLSSQYVDGLRGPLVIYDPKDPHRRLYDVDDEKTVLIIGDWYHESSKAILASGNITRQRPVSATINGKGRFDPDNTPANPDTLYTLKVKRGKRYRLRVINSSEIASFRFSVEGHKVTVIAADGVSTKPYQVDAFDILAGQRIDCVVEANQEPDTYWINAPLTNVPNKTAQALLVYEEDRRPYHPPKGPYRKWSVSEAIIKYWNHKHKHGRGLLSGHGGLKARMIEGSHHLHSRSVVKRQNETTTVVMDESKLVPLEYPGAACGSKPADLVLDLTFGLNFATGHWMINGIPYESPKIPTLLKILTDEDGVTESDFTKEEHTVILPKNKCIEFNIKGNSGIPITHPVHLHGHTWDVVQFGNNPPNYVNPPRRDVVGSTDAGVRIQFKTDNPGPWFLHCHIDWHLEEGFAMVFAEAPEAVKGGPKSVAVDSQWEGLCGKYDNWLKSNPGQL

SEQ ID NO: 1189 - protein, 733 aa, Cytophaga hutchinsonii ATCC 33406
MNDEKRLIIVAYRIPFKVTFKESGERVLQQNSGGLVSAILSLAEKGDVFGKNQKIHWFGYSTPDILQEGETQVENENFIVHPVLIEDALNDAYYEGFCNSTIWPISHYYPYLTSFNEEDYEAYVKANKIFADQINAFIRPGDMVWIQDYQLMLLPGMLRSENPDASIGYFHHIPFATFEIFRLLPKQWQTELLKGMIGADLVGFHTNDYSQYFLRSVQRVLGYDTTARDISIPNRIVRVDTFPISIDYNKFQELYNDPGVIEKRKEFLKDLSAEKNIFSVDRLDYSKGLIHRLNGFEYFLDQYPQWHTRVVLTMIVVPSRETILKYAEMKHELEEAVGRINGKYGTLGWRPVIYLYRSLSFEELGALYTLADVALITPIRDGMNLVAKEFVATRTDKKGVLILSEMAGASLELNGAILINPTDKRTLAAAIIQALTMDEQEQTQRMQMMQDRIRVYDIFKWTEDYMDQLDIIKLKQMEFEEKIINQDVLKSFKQIFDESSRRLFLLDYDGTLSPIVPDPSSSKPSVGIVDVLKKLSSDFNVNVAIISGRDKEFLNYIFDPNTILSAEHGAFLRIPGQDWELQYDYNDQWKRSVLPVFQKYTDRCAGSFIENKSTSLAWHYRNTEKEYAHIRSREFIEELENKVGIKSNLAIIDGDKVIEMKPSDVDKGIAARKICDLYQPDFILSIGDDRTDEDMFKALPDNALTIKVGVKNSSAKFTIKTQEEVMTILNTFL

SEQ ID NO: 1190 - protein, 458 aa, Burkholderia mallei ATCC 23344
MSRLIIVSNRVAPISEGEPAAGGLAIGVYDALKETGGMWFGWSGEVIASGGPQIRIEEHGPVTFATIGLSRRDYDQYYRGFSNATLWPAFHYRADLIQFDRHEFEGYSRVNVWLAQQLVPLLRDDDVIWVHDYHLIPFARALRTAGVKNRIGFFLHIPFPAAQVLVNVPPHRELVEALCSFDLLGFQTDTDLRAFFEYVEYEAGGTVDRAAHPARVDAFGRTLRAAAYPIGVYPDEIAALAKAGENGRAVKSLAASLRGRQLVMSVDRLDYSKGLVERFRAFEKLLEHETSFRNRVSFLQIAPSTRADLRAYQDIRRQLEGESGRINGRFAELDWAPILYIHRQYERPVLAALYRLARVGYVTPLRDGMNLVAKEYVSAQDPDDPGVLVLSRFAGAACELTGALIVNPIDIGGMADALSRALSMPLAERRARHADMLARLRENNVSVWRDHFLRDLGR

SEQ ID NO: 1191 - protein, 653 aa, Vitis vinifera
MMVGFGGEGDDLYAELWKACAGPLVDVPRRGERVFYFPQGHVEQLEASTNQELSQRIPLFNLPSKILCRVIHIQLRAEQETDEVYAQITLLPEPDQAEPRSPDPCTPEPPRPTVHSFCKVLTASDTSTHGGFSVLRKHANECLPQLDMNQATPTQELVAKDLHGYEWRFKHIFRGQPRRHLLTTGWSTFVTSKRLVAGDSFVFLRGDNGELRVGVRRLARQQSTMPTSVISSQSMHLGVLATASHAVATQTLFIVYYKPRTSQFIIGLNKYLEAVSNGFAVGMRFKMRFEGEDSPERRFSGTIVGGEDFSPEWKDSEWRSLKVQWDEPASIPRPEKVSPWEIEHYVSSVPQGLAPPGVLKNKRPRSNESPVPGSAAASAVWHLGLTQSHDLTQMSSTAEGKRSENHQADIGAIPPTEGSWLSSSHVSASQHQFQDATEDSKSVSAWPALSGYSTLHSSKLTSDTIIDPNGNGKKAVAEMATSCRLFGFELMNHSSSPPVGKAHGHSISSDLSKASKEQKQGQSHVSPKEIQSKQNCYSNTRSRTKVQMQGIAVGRAVDLTALEGYDELIDELEEMFEIKGELRPRYKWEIVFTDDEGDMMLVGDDPWPEFCNMVRRIFICSSQDVKKMSPGSKLPISSMEGEGTTISLDSTEN

SEQ ID NO: 1192 - protein, 175 aa, Shewanella oneidensis MR-1
MATVGLFFGSDTGNTEAVAKMIQKKLGKKMVEVKDIAKSTKEQIAEYDLLLFGIPTWYYGEAQCDWDDFFPELEQIDFTDKLVAIFGCGDQEDYAEYFLDAMGMIGDIVQARGGIIIGHWPTASYNFEASKGLVDDDHFIGLGIDEDRQPELTEERVDAWVKQIYEEMCLAELED

SEQ ID NO: 1193 - protein, 352 aa, Litchi chinensis
PDGEQTIVLASWYNSDVMEVYEEAVASGEEFNTSDAFTINGQPGALYDCSTGTTFRMNVTSGKTYLLRIINAVLNEEMFFGIANHNLTVVGTDGFYTKPINAEYIFITPGQTIDVLVTANQTPSYYYMAASPFSDSEADFDNSTTVAYFQYIGNETVPDPIPFPSLPGTNDSGPPFGFIRQLRSLADAAHPVSVPTNITKHIYMTASVNLIYCPNDSCSANLGGDKLGASLNNQSFQFPSIDILQAYYNNISDVFTTDFPLEPPIFFNFTAVEPNMTVYAGQGTKVIELDYGDEVELVFQGTNLGNAQNHPMHLHGYSFYMVGLGFGNFNSSTDSSTYNLVDPPEVNTIQLS

SEQ ID NO: 1194 - protein, 414 aa, Dechloromonas aromatica RCB
MKHVKKSAKLANVCYDIRGPVLQKAKQMEEEGHKIIKLNIGNLAAFGFDSPEEIQQDMIRNLPNAAGYTDSKGIFAARKAIMHYTQQKGIKGVTLEDIYVGNGVSELIVMAMNALLDAGDEVLVPAPDYPLWTAAISLSGGTPKHYLCDESKGWLPDLDDIRSKINAHTKAIVLINPNNPTGALYPDDLLYEIIDIARQHHLTIYADEVYDKVLYDDVKHTSIASLAEDVLMITFNGLSKNYRSCGYRAGWMVVSGDKRHAKDYIEGLDMLASMRLCANAPGQHGIQTALGGYQSINDLIKDGGRLRRQRDIAHELITAIPGVTCVKPKAALYMFPRLDPKIYPIKNDQQFISELLQEEKVLLVQGTGFNWPHPDHFRLVFLPHEDDLREAVARIARFLENYRKRHNTNQLIKD

SEQ ID NO: 1195 - protein, 177 aa, Vibrio parahaemolyticus RIMD 2210633
MASVGIFFGSDTGNTEAVAKMIQKQLGKHLVHVQDIAKSSKEDIDNFDLLLLGIPTWYYGEAQCDWDDFFPELEQIDFSTKLVAIFGCGDQEDYAEYFCDAMGTVRDIVESKGGTILGHTSTEGYEFEASKALVEGDDSQFVGLCIDEDRQPELTDQRVENWVKQIYEEMCLAELEG

SEQ ID NO: 1196 - protein, 527 aa, Trametes villosa
MGKYHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHEALDVDSIQIFAGQRYSFILNANQSIDNYWIRAIPNTGTTDTTGGVNSAILRYDTAEDIEPTTNATTSVIPLTETDLVPLDNPAAPGDPQVGGVDLAMSLDFSFNGSNFFINNETFVPPTVPVLLQILSGAQDAASLLPNGSVYTLPSNSTIEISFPIITTDGVLNAPGAPHPFHLHGHTFSVVRSAGSSTFNYANPVRRDTVSTGNSGDNVTIRFTTDNPGPWFLHCHIDFHLEAGFAIVWGEDTADTASANPVPTAWSDLCPTYDALDSSDL

SEQ ID NO: 1197 - protein, 170 aa, Microcystis aeruginosa PCC 7806
MAKIGLFFGTQTGKTETVAEMIQKEFGGEAIVELHDISSASTEDFAPYDALIIGCPTWNIGELQSDWAGFYDELDDIDFVSKKVAYFGMGDQIGYADNFQDALGILEEKIASLGGKTVGYWPTEGYDFNESKALKNGKFVGLALDEDNQSDLTEQRIKTWVAGLKGEFGV

SEQ ID NO: 1198 - protein, 678 aa, Vitis vinifera
MVETLVKRSFRDSASASRSFASSFPAMTRELRGLFCPGERERATSFGRKEAEFEVEATHERMMDLCPGWGAELRKRRLWSATCQICVREQKKKPVKLGGFKVKRVGVGRRIQPFGCFALTNVEAPLRIKKMRRFVSGVLSSYQKRSLSHRSLRFFSSTTSLPNSDSPSPSSSSSAAMPTPVTLETINPKVLECEYAVRGEIVTLAQLLQQELQEKPGSLPFDEILYCNIGNPQSLGQQPITFFREVIALCDHPPILDKSETQGLFSADAIERAWQILDQIPGRATGAYSHSQAMIIPPSTMGFWEGIKGLRDTIAAGIEARDGFPSNPNDIFLTDGASPAVHMMMQLLIRTEKDGILCPIPQYPLYSASIVLHGGTLVPYYLDEATGWGLEISELQKQLEDAKSKGITVRALVVINPGNPTGQVLSEDNQRDIVEFCKKEGLVLLADEVYQENVYVPDKKFHSFKKISRSMGYGEEDISVVSFQSVSKGYYGECGKRGGYMEVTGFGADVREQIYKVASVNLCSNITGQILASLVMSPPKTLEDALNSLEGVTCNKAEGAMYLFPRIHLPEKAIKAAEAAKTAPDAFYARRLLNATGIVVVPGSGFRAVWLGLLITPMGVSSYSNSSKSGGHTHLESEIHVPGTWHFRCTILPQEDKIPAVVSRLTEFHKGFMEEFRD

SEQ ID NO: 1199 - protein, 482 aa, Triticum aestivum
MAATVAVDNLNPKVLKCEYAVRGEIVIHAQRLQQQLQTQPGSLPFDEILYCNIGNPQSLGQQPVTFFREVLALCDHPDLLKKEEIKTLFSADSISRAKQILALIPGRATGAYSHSQGIKGLRDAIASGIASRDGFPANADDIFLTDGASPGVHLMMQLLIRNEKDGILVPIPQYPLYSASIALHGGSLVPYYLNESTGWGLEISDVKKQLEDARSRGIDVRALVVINPGNPTGQVLAEENQYDIVKFCKNEGLVLLADEVYQENIYADNKKFHSFKKIVRSLGYGEDDLPLVSYQSVSKGYYGECGKRGGYMEITGFSAPVREQIYKIASVNLCSNITGQILASLVMNPPKASDESYASYKAEKDGILASLARRAKALEIAFSKLEGITCNKAEGAMYLFPQICLPQKAIEAAKAANKAPDAFYALRLLESTGIVVVPGSGFGQVPGTWHFRCTILPQEEKIPAIISRFTVFHETFMAEYRD

SEQ ID NO: 1200 - protein, 153 aa, Vitis vinifera
MAGSSSMPSLPPPCPKSPPDYPDLYGKRRGAAKVQMLEREIGFLEEELKSIEGLQHASRCCKEVVDFVVANSDPIIPTNSKSRKSCRFWKWLWYIFSFPFFCMFCIYEAMFSCSYLIIINCVLHVPNFSTLISGKLSTIFNLVVNFNAGLPIS

SEQ ID NO: 1201 - protein, 913 aa, Vitis vinifera
MPGNKYNGISSVPTSRVERLLRDRELRKSSRASHPNEANDTNRGTEVLEHEGDNLGSSHVEQHSETAAIRGVLSEECEKQETRPARQRLLVVANRLPVSAIRRGEESWSLEISAGGLVSALLGVKEFEARWIGWAGVNVPDEAGQRALTKALAEKMCIPVFLDEDIVHQYYNGYCNNILWPLFHYLGLPQEDRLATTRSFQSQFAAYKKANQMFADVVNKHYEEGDVVWCHDYHLMFLPKCLKKYNSEMKVGWFLHTPFPSSEIHRTLPSRSELLHSVLAADLVGFHTYDYARHFVSACTRILGLEGTPEGVEDQGRLTRVAAFPIGIDSHRFIRALDAPQVQDRINELKRTFTGRKVMLGVDRLDMIKGIPQKILAFEKFLEENSEWQQKVVLLQIAVPTRTDVPEYQKLTSQVHEIVGRINGRFGTLTAVPIHHLDRSLDFYALCALYAVTDVALVTSLRDGMNLVSYEFVACQESKKGVLILSEFAGAAQSLGAGAILVNPWNITEKEKNGMSITFEHVKNHTAQEWAETFVSELNDTVVEADLRKRKVPPRLTPENAIKCYLQSNNRLLILGFNVTLTEPVDTPGSRGGDQIKEMDLKLHPELKGPLTALGNDPKTTIVVLSGSDRTVLDDNFGEFDMWLAAENGMFLRHTKGEWMTTMPEHLNMEWVDSVKHVFEYFTERTPRSQLQKRETSLVWNYKYADAEFGKLQARDMLQHLWTGPISNASVDVVQGSRSVEVRAVGVTKGAAIDRILGEIVHNKSMTSPIDYVLCAGHFLGKDEDVYTFFEPELPSDNISMAKSRAIDAFKLSGERKSSLKLPANKSGSKSSHGKTQRPLPNPDKKTPDHSSGSGSGRRPSPEKTSWNVLDLKGENYFSCAVGRTRTKARFTFGSSDEVVSFLKELAGAKSSF

SEQ ID NO: 1202 - protein, 764 aa, Xanthomonas campestris pv. campestris str. ATCC 33913
MILATDLDGTFLAGSAEHRHQLYRLVDQHPEIRLIFITGRGLEAVMPLLTDPTIPRPDYVVCDVGATVVDGHTLQPLQPLQSMIDAHWPGEQVVAQAMRAFPQLQRQDMPQERRCSYFCDPHTLAPLRAQIEQTARALGCDVLYSADRYLDILPPDTDKGRTLGALARQLELPRERILVAGDTLNDLSMYLAGFRGVCVGDSEAALTQATAQLDATYHASAPGCGGILEAIAHFGLLADDDPHVPAVQAPRKGGAELVMVYHRLPYDEVVEHGELVRRAPRSPNGIIPSLLSFFEGGQRGSWVAWSVDDPKRGPFQTHTEVDAQRYPTLTAARVPLSKSEVDIFYKRFSKEAFWPMLHVFWERARFREDDWQVFLAVNRKFAQATSAEAAHGATVWIHDYNLWMVPAYLRELRPDLKIAFFHHTYFPSADVFNVVPWRREIIGSLMCCDYVGFHIPRQVENFVDVVRGVMPVERLAQESCAPRFLTYGCAVGLDTMTTCLRVADRDVALGAHPVGTDLRRIRAALSKPDVRNDIFKLRREIGARKLVLSVERLDYTKGTLAKLEAFERLLDSQRQLLGKVTLLMVCVPAAREMTIYRTLQTQIEQAVGRINGRFSRLDWTPVRFFAQALPFEQVVAHYAAAQVMWITPLRDGLNLVAKEFVAVQGIEGGSGVLVLSEFAGAAAELKGAVLTNPHDPADLAAGLLQALAMPDDEAAGRLRQLYDSVEYYNIDHWGRDFLDAVARSRGAHARVPLAAASTVAEPVA

SEQ ID NO: 1203 - protein, 478 aa, Acinetobacter sp. ADP1
MSRLIILSNRVSLPQTECVAGGLAVAMQDALSQLGGVWVGWNGKKIEQPFEQHFDILYKSKITYMTCALTQQQYQDYYCGFSNNTLWPAMHDREDLIEYNPKEFKTYQDVNRLFATKIAEFAQPDDLIWVQDYHFLSVARHCRELGMQNKIGFFLHIPFASLEIWRKIPCAEQLMDDLCHYNLIGLQTAQDQENCISVCSVLLKAQKIQNNMISLNQRVTQIQDYPIGVDVKGIQKTLSNLSDQDQYLTNPSAIKTIIGVDRIDYSKGLFERFNAFAEFLDRNTAFHQKVQHVQIASPCRLEVATYKRLFERFKLKVELINSEFSQDNWLPIVCHYDSKPHHELMQFYRNADICWVTSLKDGMNLVAKEYIAAQNPDNPGVLILSEFAGAAEQMQDALIVNPKNRDAMIKALKLALNMSLEERQYRYHKLIKQLIEYDINQWRDDFLKDLNSSQYIQNFDYNHRLSTVLFYPNYSSRI

SEQ ID NO: 1204 - protein, 271 aa, Zea mays
KGLGPSSQEQQLSCLHQGNPTGQVLAEDNQYDIVKFCKNEGLVLLADEVYQENIYVDNKKFNSFKKIVRSMGYGEDDLPLVSLQSVSKGYYGECGKRGGYMEITGFSAPVREQIYKIASVNLCSNITGQILASLVMNPPKAGDESYASYKAEKDGILESLARRAKALEDAFNKLEGFSCNKAEGAMYLFPQIHLPQKAIEAAKAAKKAPDAFYALRLLESTGIVVVPGSGFGQVPGTWHIRCTILPQEDKIPAVISRFRAFHEAFLAEYRD

SEQ ID NO: 1205 - protein, 632 aa, Cryptococcus neoformans var. neoformans JEC21
MTRISALLATIPLLAQAVSAATIEHWWNISYAVANPDGLFERRVIGVNGSWPPPPLLATQGDTILIHAYNGLNDPNIGTALHTHGISFNGSNYYDGAVGITQCSIPMGETLDYVIDTNLQAGTFWMHGHYLGQYVDGLRSPLVIEPQNATGRSDDLTWDDDYTLVVSDWYHRQHLDLLTNDFLTWENPTGAEPVPDSAVIYLVKDGKYYPSAEDVANGAAVSDNLSIPFEAGKKYKIRVINMSALAMFYIALDQHDINIIEVDGVEVEPYSVDALPLSVAQRYSILVEAKNETDRNYAMTVMQDVEMYDYLPDELVLNNTIQISYSSSNPHADEVVYPEEFTDIDDTLLTPLLRSAMAPADIEYTLHVNFDTYDDGNNRGSFNNVTFQEPPTASIFTALTMGNASFLPSVYGAQTNAFTYPHMANIQLTVYNWDAGSHPFHFHGHEFQVVQKSFDVTDEEDEGNGEIVEGQENPMRRDTITIPATGKVVLRWRADNPGAWFFHCHIDWHLSSGLAAVFIEAPEKFQENTVVPQTIVDHCKYWGLPTSGNVVGLNSTTDFDGQPWGPFPLVIGWTPAALTSIFFCVTTAVIGIATVLWYNQDTLDSRDMEEHIRRKIEAKKRRSGLLRRLRGE

SEQ ID NO: 1206 - protein, 169 aa, Bacteroides fragilis YCH46
MNKIGVFYGSTTGTTEDVAHRIAEKLNVPNGDIHDASKLNDELVKEYDVLVLGTSTWGAGELQDDWYDGIKVLKKADLSHKFVALFGCGDSDSYSDTFCDGIGILYEELKDTHCTFCGATDPSGYTFDSSVAVINGKFVGLPLDEVNEDGKTDERIAQWTEALKKECIN

SEQ ID NO: 1207 - protein, 533 aa, Pleurotus sp. 'Florida'
MAVAFVALVSLALALVRVEASIGPRGTLNIANKVIQPDGFYRSTVLAGGSYPGPLIKGKTGDRFQINVVNKLADTSMPVDTSIHWHGLFVKGHNWADGPAMVTQCPIVPGHSFLYDFEVPDQAGTFWYHSHLGTQYCDGLRGPLVVYSKNDPHKRLYDVDDESTVLTVGDWYHAPSLSLTGVPHPDSTLFNGLGRSLNGPASPLYVMNVVKGKRYRIRLINTSCDSNYQFSIDGHTFTVIEADGENTQPLQVDQVQIFAGQRYSLVLNANQAVGNYWIRANPNSGDPGFENQMNSAILRYKGARSIDPTTPEQNATNPLHEYNLRPLIKKPAPGKPFPGGADHNINLNFAFDPATALFTANNHTFVPPTVPVLLQILSGTRDAHDLAPAGSIYDIKLGDVVEITMPALVFAGPHPIHLHGHTFAVVRSAGSSTYNYENPVRRDVVSIGDDPTDNVTIRFVADNAGPWFLHCHIDWHLDLGFAVVFAEGVNQTAAANPVPEAWNNLCPIYNSSNPSKLLMGTNAIGRLPAPLKA

SEQ ID NO: 1208 - protein, 492 aa, Mycobacterium avium 104
MAPGGGRGSKTASYGNSDFVVVANRLPVDQERLPDGSTAWKRSPGGLVTALEPLLRRQRGAWVGWPGIVDEDVDHEDDPIVQDDLELRPVKLSADDVAEYYEGFSNATLWPLYHDVIVKPIYHREWWDRYVAVNRRFAEATSRAAARGATVWVQDYQLQLVPAMLRELRPDLTIGFFLHIPFPPVELFMQLPWRTEIVKGLLGADLVGFHLTGGAQNFLFLSRRLIGANTSRGAVGVRSRYGEVELESRVVRVGAFPISIDSTALDQTARHRDIRRRAREIRAELGNPRKVLLGVDRLDYTKGIDVRLKAFSELLAEGRAKRDDTVLVQLATPSRERVDSYQQLRNDIERQVGHINGEYGEVGHPVVHYLHRPVPRNELIAFFVAADVMLVTPLRDGMNLVAKEYVACRSDLGGALVLSEFTGAAAELRQAYLVNPHDLEGVKDTVEAALNQSVEEGRRRMRSLRRQVLAHDVDRWARSFLDALAESGPRDG

SEQ ID NO: 1209 - protein, 77 aa, Glycine max
VKKGGKVPNVFSSPKLLETPGKTPVFGSEFGKKKRVFPLRATIFPAEENKPEIMESFKKFKDEFMEQNENEKGYSRV

SEQ ID NO: 1210 - protein, 530 aa, Arabidopsis thaliana
  misc_feature (322)..(322): Xaa can be any naturally occurring amino acid
  misc_feature (345)..(345): Xaa can be any naturally occurring amino acid
  misc_feature (410)..(410): Xaa can be any naturally occurring amino acid
MRRFLINQAKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILCPIPQYPLYSASIALHGGSLVPYYLDEATGWGLEISDLKKQLEEARSKGISVRALVVINPGNPTGQVLAEENQRDIVNFCKQEGLVLLADEVYQEXNVYVPDKKFHSFKKVARSLGYGXKDISLVSFQSVSKGYYGECGKRGGYMEVTGFTSDVREQIYKMASVNLCSNISGQILASLVMSPPXERDGILSSMAKRAKTLEDALNSLEGVTCNRAEGAMYLFPRINLPQKAIEAAEAEKTAPDAFYCKRLLNATGVVVVPGSGFGQVPGTWHFRCTILPQEDKIPAIVNRLTEFHKSFMDEFRN

SEQ ID NO: 1211 - protein, 174 aa, Haemophilus ducreyi 35000HP
MAVVGLFYGSDTGNTENISKMIQKEIGANLIDVRDIAKSSKEDIEGYDFLLLGIPTWYYGESQADWDDFMPTLKQIDFGGKVVGIFGCGDQEDYAEYFCDAMGTIRDVVEQNGGVIVGHWSTEGYNFEVSQALVDEHTFVGLCIDEDRQPELTSERVSRWSKQIFEEMCLDQLA

SEQ ID NO: 1212 - protein, 626 aa, Candida albicans SC5314
MRFIVSSFIFFISFLSSLITAETHTWYFKTSWVDANPDGVFPRKMIGFNDSWPLPTLRAKKGDRIQLYLINGFEDLNTTLHFHGLFQHGTNQMDGPEMVTQCPIPPGETYLYNFTIDDQVGTYWYHSHTSGQYGDGMRGVFIIEDDDFPYDYDEEIVLTLSEHYHDYSKDLMPGFLSRFNPTGAEPIPSNILFNETRNNTWKVEPGKTYLLRIANTGRFVTQYLWMEDHEFTVVEVDGVYVEKNTTDMLYITIAQRYGVLITTKNSTDKNYAFMNRVDDTMLDTIPKDLQLNGTNYIVYNESAPLPDAYDVDSIDDYLDDFYLKPLNKEKLLDDADYTITVDVQMDNLGNGVNYAFFNNITYMTPKVPTLLNVLSAGDASTNELVYGSNTNSFVLQGGDVVDIVLNNLDTGRHPFHLHGHVFQLIERHEEIPDTEDPVSYNVSDHAEWPEYPMSRDTVYVKPQSYIVMRFKADNPGVWFFHCHIEWHLDQGLAIVLIEDPEAIQKNSSQHLTDNHKQICEKVGVSWEGNAAANSNNYLDLKGENIQVKRLPTGFTARGIVALVFSCIAAFLGIAAIAYYGMNDIEDVEERVARDLDVDLDEENEDEEEAEIVNEGSSSSGSNSKQH

SEQ ID NO: 1213 - protein, 164 aa, Helicobacter pylori
MGKIGIFFGTDSGNAEAIAEKISKAIGNAEVIDVAKASKDQFNSFTKVILVAPTAGAGDLQTDWEDFLGTLEASDFANKTIGLVGLGDQDTYSETFAEGIFHIYEKAKAGKVVGQTPTDGYHFEASKAVEGGKFVGLVIDEDNQDDLTDGRISKWVEQIKGSFA

SEQ ID NO: 1214 - protein, 408 aa, Nitrosomonas europaea ATCC 19718
MQPIKKSSKLDNVCYDIRGPVLDRARQMEDEGQRVIKLNIGNPASFGFEAPDEILQDVIRNLSAASGYCDSKGLFAARKAIMHYTQEKNIANVQMDDIYIGNGVSELIMLATQALLENGDEILVPSPDYPLWTAAISLAGGVARHYTCDEQSSWLPDPENIKAQVSSRTRAIVIINPNNPTGALYPDDLLREIIEIARRNNLIIFADEIYDKILYDSASHTSVASLADDVLFVTFNGLSKNYRAAGFRSGWVVVSGNKTHARDYITGLNMLASMRLCANVPAQFGIQTALGGYQSIHDLTMPTGRLKRQRDLAWKLLTDIPGVTCFKPQSALYLFPRLDPDYYPVKDDEQFALDLLLEEKVLVVQGTGFNWSQPDHFRIVFLPNSDDLTEAIGRIAKFLDRYRTRHGS

SEQ ID NO: 1215 - protein, 362 aa, Glycine max
MFRVCDVRRLRSLPPLFSRMFSSEPVLTQETINQHVVKAEYAVRGELVLLANKHQKTMQQNPNHSLPFKEIIYCNIGNPQILGQKPLTFFRQVTACCEYPALLDLPNVMPEDVKERAKKLLASMGNSTGAYSSSQGVPIVLNNVAKFIEERDGHPANAEDIFLTDGASVGVQRMLRLLIRDDKDGILIPIPQYPLYSATIDLYGGQRVGYYLNEEANWRLDTPQLEKALDEAKKKGINTRALVVINPGNPTGNTMDRKAMEEVVDFCYRNKLILMADEVYQDNIYKEGQSFISFKKVLREMEEKYQKLELVSFHSVSKGFYGECGKRGGYLEMVNISEPVKEHKSLQPGGSTTSRAVATAEE

SEQ ID NO: 1216 - protein, 224 aa, Arabis procurrens
QCPIRPGKSYTYRFTIQGQEGTLWWHAHSSWLRATVYGALIIHPTIGSSFPFPKPDRQTAIMLGEWWNANPVDVMKEATRTGAAPNISDAYTINGQPGDLYKCSTKETVVVPINSGETSLLRVINAALNQPLFFTVANHKLTVVGADASYLKPFTTKVLMLGPGQTTDVLLTADQPPKRYYIAARAYQSAQNAPFDNTTTTAILQYRKTATTSPPIVPFLPPYN

SEQ ID NO: 1217 - protein, 174 aa, Haemophilus influenzae Rd KW20
MAIVGLFYGSDTGNTENIAKQIQKQLGSDLIDIRDIAKSSKEDIEAYDFLLFGIPTWYYGEAQADWDDFFPTLEEIDFTDKLVGIFGCGDQEDYADYFCDAIGTVRDIIEPHGAIVVGNWPTEGYNFEASKALLEDGTFIGLCIDEDRQPELTAERVEKWCKQIYDEMCLAELA

SEQ ID NO: 1218 - protein, 516 aa, Zea mays
MAAAMVRTMSTTAAGTPPVSVATINPKLVWVALICDRIAGRLKVSISVLKCEYAVRGEIVTHAQNLQQELQKNPESLPFDEILYCNIGNPQSLGQQPVTYFREVLSLCDHPALLDKSETHALYSSDAIERAWQILEKIPGRATGAYSHSQGIKGLRDEIAAGIAARDGFHASGDNIFLTDGASPAVHMMMQLLISSESDGILCPIPQYPLYSASIALHGGSLVPYFLNEETGWGLDVDELKKQLEEARSKGITVRALVVINPGNPTGQVLVEENQKKIVEFCKNEGLVLLADEVYQENIYVEDKPFHSFKKIARSLGYTDDDLPLVSFQSVSKGYYGECGKRGGYMEITGFSPEVREQIYKVASVNLCSNVSGQILASLVMNPPKAGDESFESFMSEKDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSRLKEFHEKFMDEFRD

SEQ ID NO: 1219 - protein, 175 aa, Moritella sp. PE36
MASVGLFFGSDTGNTEVVAKMIQKQLGKQLVDVKDIAKSTTADINEFSLLILGIPTWYYGESQCDWDDFMPSLEEIDFSDKLVAIFGCGDQEDYAEYFLDAMGTLRDVVEAKGGTIIGEWSTEGYDFEASKALTDDNHFVGLGIDEDRQPELTAERVEAWVKQIHSEMCLAELED

SEQ ID NO: 1220 - protein, 147 aa, Bacillus cereus ATCC 10987
MAKILIAYASMSGNTESIADLIKVSLDAFDHEVVLQEMEGMDAEELLAYDGIILGSYTWGDGELPFEAEDFHDDLENIDLSGKKAAVFGSGDTAYELFCEAVTIFEERLVERGAELVQEGLKIELAPEDEEDVEKCSNFAIAFAEKF

SEQ ID NO: 1221 - protein, 227 aa, Glomus mosseae
RDGMNTTSLEYIMCQQENHGPLILSEFTGMAGSLGTAIMVNPWDYDGVAKTINDALSLPAEEKKAKHMQLYKHVTVHTAQFWAKSFTKELVASLNNHNQSSITPYLDMDYLQKKYKSAKKRLLLFDYDGTLTPIVRTPSAAVPPPRMLEALDELTNDPNNTTWVVSGRDSTTLENWLGSVKKLGFSAEHGSFLKNPDGDKWINLTEDIDMSWKNDVLEIFTYYTERT

SEQ ID NO: 1222 - protein, 933 aa, Gibberella zeae PH-1
MTVFVCSLFLPKTIHFTLPGTPPPGVDPSRTSLSGSSNINLRGDTRASLSGSAVPKDGAALPPKTAAPVGGRPAPLNRQPSLFQKEDITPPRTPTEEVDVNLFANEDGIRIPFPKRPGSNAGSGKPWGSRANQPKSRASSPPPPALSENSRTMQKARELGRQGVIQPKPLVRSDSHDRVFASAGWMVVNADQGNGGLRNAADAAARDGKIDEITWVGTLGMPTDALEGTEQKQDIENTLANEHNMLTVFCSDKDFDGHYAHFCKHILWPVFHYQIPDNPKSKAYEDHSWKYYVNVNQAFADQIVKNWKRGDVVWIHDYHLLLVPEMVRKKIPEAKIGFFLHVAFPSSEVFRCLAVRKELLEGMLGANLVGFQIHEYGRHFLQTCSRILNAEATPDGLQLEDRFVDVIHLAIGIDPVSLREHLDAPEVAKWLQIMQERYKGKRLIVARDKLDHVRGVRQKLLSYELFLNKNPQWRENTVLIQVALSSSEKSDLEATVSDIVTRVNSSWANLAYQPVVYLKQDIDYAQYLALLTIADALMITSQREGMNLTSHEYLFCQDGKLLPEKKHGSLILSEFTGTSSLFAKNELAVNPWDYRACADAIKQALEMGQDEKDQRWNNLYGRVVKHTGSHWFTEFLGRLDIVYEEQHKRDQTSVPRLSVPALSSKYTKAERRLFIIDYEGTLVAWGPVNQIIPISPQRTLDVLNDLLLDERNTVYVMSGRRPEELDRVFRRVPNLGLIAENGCFLKSHGDDSWTEMADLDHVKDWKESVRPIMTYFLERTPGAEIEERRCSLIFHYKSAEDYETASRQASDCASHVNDACESQRVHAIALDGCIAVEPIDWTKRTAARKVFETLKEEIHPTTEKKAPVDFLMVIGDGREDEKVFKWANRLQDDGSVENVVTVSLGNRNTEATATLTQGVSGVLSCLQRLASLE

SEQ ID NO: 1223 - protein, 175 aa, Fusobacterium nucleatum subsp. vincentii ATCC 49256
MNYDGGIFMKTIGIFYATLTKTTVGIVDEIEFFLKKDDFKTFNVKNGVKEIENFENLIFVTPTYQVGEAHAAWMNNLKKLEEIDFTGKVVGLVGLGNQFAFGESFCGGIKYLYDIVIKKGGKVVGFTSTDGYHYEETSIVKDDKFIGLALDEENQPNLTPKRIGDWIAEIKKEFK

SEQ ID NO: 1224 - protein, 423 aa, Xanthomonas campestris pv. campestris str. ATCC 33913
MSTAPQKPLAIRERLSEVRYEIRGELARRARELEAQGRKLIKLNIGNPGAFGFRAPEHLQRAIADDMGRTDPYTHQQGLPEAREAIAAAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIAVKHNLLLMVDEIYDQVLYDGAAFVPVAPLAGEHPCITFSGLSKVHRACGWRVGWALLSGEQSRINDLRNAMDLLGALRLCANVPGQYAIDAAVNGPDTISALCAPGGRLYETRRAVIEACAASSHLSLVAPAGALYAFPAVVGPAARAFDDHTFALDLMNDEGVLVVPGSSFNVPYRHHFRVTLMPEAAVMRDVFARIDRALTRRAEAVTKVVPLKSRSVA

SEQ ID NO: 1225 - protein, 502 aa, Microcoleus chthonoplastes PCC 7420
MKSSLVILYHREPYDEVVENGKVHYRAKKSPNGIVPTLKSFFAGVNQGTWIAWKQVNAKQKANFEQRIVVEGEANYNVRRIPLSADQVKHFYHITSKEAFWPILHSFPYHFTYETSDWENFHTINRLFAEAACDEAADDALIWVHDYNLWLVPYYIRQLKPNARIAFFHHTPFPSVDIFNILPWREEITDSLLCCDIVGFHIPRYSENFVNVARSLRPVEIVKKEPVPEHITPMGIALAEPEMTTQIRYKDQLVNIDPFPVGANPQQILSILHKPETQKRFEEIKESLGDRKLIISAGRVDYVKGTREKLEAYGRLLARRPDLHGKINMLVTCVASASGMRVYKTAQTQIEQLAGKINGRYGNLDWLPIMLYTQPVPLPDLLCYYKAADICWTTPLRDGLNLVAKEYIITHEKQEGVLVLSEFVGAAVELPDAILTNPYSIDRMDESIEQALAMSPEEQKERMAKMYDIVTKYDIQCWADHLFEMFEKTKHQTAKQQQAVAV

SEQ ID NO: 1226 - protein, 612 aa, Triticum aestivum
  misc_feature (353)..(353): Xaa can be any naturally occurring amino acid
FLPEEEPKSIPIVYIPIVFLGRLERYKLPGPGSPKKDLPFPLSETLTPPPVNRLQPRNSSSSSMAQLLWLALGVLLLASSVADAATANYTFTVQSMKINQLCNSTDIIAVNGQLPGPTIDVFEGDEVVVDVINASPYNLTIHWHGILQKLTPWADGPSMVTQCPIQPNGSYTYRFNVTGHEGTLWWHAHSSFLRATVYGALIIRPRNGTAYPFPAPDQEVPVVLGEWWSQNVVDVEKDAVMAGQLPSHSDAFTINGLTGQLYQCANETFTAVVQPNTTVLLRVINAALNTHLFFKVAGHNFTVVAVDACYTANYTTDTLVLAPGNTVDALVYTGAAPGSYYMAVEPHHTLSPXRPPRTPPTAAPSPRASLLYNGTSATATPAMPAMPNNSDSTTANDFYSGLRGVPAAVPSPVDVNMTIQLGLGQLPCDAAQTNCSVNAFAAAMNGVSFRLPTQMSLLEAQFGNASGVYTADFPDGVPPNGTAMVEGTKVRSLPYNSTVEVVLQNPMAFPSESHPIHLHGFNFFVLAQGLGTFAPGNASAYNLVDPVARNTIAVPAGGWAVIRFVANNPGMWFFHCHLDAHVPMGLGMVFAVENGTTADSMLPPPPADLPVC

SEQ ID NO: 1227 - protein, 249 aa, Brassica napus
VKTHTAQEWAETFVSELNDTVIEAQLRISKVPPELPQDDAIRRYSKSTNRLLILGFNATLTEPVDNQGRRGDQIKEMDLNLHPELKGPLKTLCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPID

SEQ ID NO: 1228 - protein, 922 aa, Blumeria graminis f. sp. hordei
MTVFVGSLFLPDTIHFAIPSQVTEDDLYTIQRKSIGGNNQNLSLPSFPSVRDPTPPQSPTVVKNHDDDKFFARSDNPELRGQVSSSVKLTPNNPNSRAWGAGTVFNQPKSRASSPPPANILRHNRTLRKAKSFGRPSNRHPHLGRHENQDILFASAGWVVVPADQGNGGLRNAVQAAVRDGKLADKMWVGTLGMPTDVLEGTQQKQEIERRLAVEYDSLTVFCKDSDFNGHYTHYSKQILWPVLHYQIPDNPKSKAYEDHSWVYYVRVNQTFADKIIENWKKGDVIWIHDYHLLLVPRMIRQKLPDAKIGFFLHVAFPSSEVFRCLAVRTELLEGMLGANLIGFQIYEYARHFLQTCSRLLCVEATKEGVQLEDRFVDVISLAIGIDPIALDANRADPDVSKWIKTMQKRYQGKKLIVARDKLDHVRGVRPKLLAYELFLNKYPEWRNNVVMIQVATSTTEQAELDATVSDIVTRVNSSWANLAYQPLVYLKQDISYAQYIALLTIADALMITSQREGMNLTCHEFLFCQDGKFEGQNKNGCLILSEFTGSASVFGRNELSVNPWDYCQCADAIRTALEMSEDERKLRWNNLYKAVIHHTAEYWFSSFLTRLDEVYDEQNLRCTTSISRLSVDKLGQDYQSASRRLFILDYEGTLASWGSPNDIILTSPQRTLDILNDISLDDRNIVYVMSARQPEELDRLFKRVPNLGLVAENGCYIKLSNTSNWIENADPAEMREWKESVKGIMRYYHERTPGSWIETRHCSLVFHYRSCEDQESAGRLAGDCASHINDACEGQRVRAVLVEGTVVVEPIEWSKSTAAVTIFGHLGNNFADQDSKIIDFLMVVGNNRDDEVIFRWANELGRLKKVRNVTTVSLGSRTTEANYTLTQGVTGVLSVLQKISTILSNFFTIMSYDKLSQGKAL

SEQ ID NO: 1229 - protein, 519 aa, Panus rudis
MAFSTAFTSLITLAWAVGTFAAIGPVTDLHIVNDNIAPDGFTRAAVLAGGTFPGPLITGNKGDNFRINVIDDLTEESMLKSTSIHWHGFFQKGTNWADGPAFVNQCPITTGHSFLYNFNVPDQAGTFWYHSHLSTQYCDGLRGAFVVYDPNDPHADLYDVDDDSTVITLADWYHTLARQITGVPTPDATLINGLGRSASGPQDSELAVITVEQNKRYRLRLVSISCDPNYIFSIDSHNFTIIEVDGVNSKPLTVDSAQIFAAQRYSVVLNANQPVGNYRIRARPNNGDTTFTNGRNSAILRYKGATVEEPATITPPVSQTPLIEANLKPLASMPVPGTHTPGVADVVKPLQFGFNPPAFTINGASFVPPTVPVLLQILSGAKTAQEIVPSGSIIELPLNSVVELSFPNPTGAPGGPHPFHLHGHTFFVVRSAGQTTYNYDDPIARDVVSTGTAGDNVTIRFATDNAGPWFLHCHIDWHLDAGFAVVMAEGINQTQAANPTPDAWNQLCPIYNATDPSDL

SEQ ID NO: 1230 - protein, 624 aa, Candida albicans SC5314
MRTFLSSFIILTTFLASLIAAETHTWYFKTGWVDANPDGVYPRKMIGFNDSWPLPTLRVKKGDRVQLYLINGFDNLNTTLHFHGLFVRGANQMDGPEMVTQCPIPPGETYLYNFTVTDQVGTYWYHSHTGGQYGDGMRGVFIIEDDDFPYDYDEEVVLTLSDHYHKYSGDIRPAFLTRFNPTGAEPIPQNFLFNETRNATWKVEPGKTYFVRILNVGGFVSQYLWMEDHEFTIVEIDGVYVEKNTTDLIYITVAQRYGVLITTKNSTDKNYVFMNGVDTTMLDSVPADLQVNGTNYIVYNESSALPDAYDIDSYDDALDDFYLKPLSKQKLMDDADYTITVDVQMNVLNDGINYAFFNNISYKAPKVPTLLTVLSAGEAATNELIYGTNTNSFVLQGGDIVDIVLNNFDTGKHPFHLHGHVFQLIERHEAIGSKESAVTFNVSDHAEWPEYPMIRDTVYVKPHSYMVLRFKADNPGVWFFHCHVDWHLEQGLAIVLIEDPQAIQKNEKITENHKRICEKVGVPWEGNAAANSNDYLDLKGENVQVKRLPTGFTTKGIVALVFSCVAAFLGLFTISFYGMNDIAHVEDKVARDLDIDLEAENEDEEEAVVLNQNSSSSDSNSKPH

SEQ ID NO: 1231 - protein, 470 aa, Burkholderia xenovorans LB400
MGRLIVVSNRVATPTETKGSAGGLAVGVFGALKDAGGVWFGWSGDVVSETVANAGPTLEQDGAVTFATVGLTRKDYDQYYRGFSNATLWPVFHYRNDLARYEREEYTGYRRVNAWLAHKLIKLLEPDDVIWIHDYHLIPFAEALRNEGVTNRIGFFLHIPFPAPQILLNIPPHEELVKSLSCYDLLGFQTATDELAFKDYVTRHARGTVSADGLVEAFGRKLRTGVYRIGVFPDEIAEQAKRYESRQHVLDLKQSLEGRKLIMSVDRLDYSKGLVERFRAFEHLLERSPEWRGNVTLVQIAPPTRSDVATYQKIRQDLEYEAGRINGRYSGLDYTPIRYLNQQYDRWKLMSLFRESQIGFVTPLHDGMNLVAKEYVAAQNPDDPGVLVLSIFAGAAAELSGALLVNPHDAIGMCEALQRALQMPLDARQRRHEINMAALRKNDLGVWRDTFLHDLRSVPVQQPGKGGGHN

SEQ ID NO: 1232 - protein, 520 aa, Trametes sp. AH28-2
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDTHASLYDVDNDDTVITLADWYHTAAKLGPTFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPSFGNVGFAGGINSAILRYDGADPVEPTTTQTTPTKPLNEVDLHPLDTMAVPGSPVAGGVDKAINMAFNFNGTNFFINGASFVPPTVPVLLQIISGAQNAQDLLPSGSVYSLPANADIEISFPATAAAPGAPHPFHLHGHAFAVVRSAGSTVYNYDNPIFRDVVSTGTPAAGDNVTIRFRTDNPGPWFLHCHIDFHLEAGFAVVMAEDIPDVASANPVPQAWSDLCPIYDALDVNDQ

SEQ ID NO: 1233 - protein, 501 aa, Trametes sp. AH28-2
MNGLRLLPSFASLAVVVSLALNTLAGIGPVTDLTISNENVSPDGFTRAAVVANGKAPGPLITGQKGDRFQINVVNKLSNHTMLKSTSIHWHGFFQKGTNWADGPAFVNQCPIATGHSFLYDFQVPDQAGTFWYHSHLSTQYCDGLRGPFVVYDPNDPNASLYDVDNDDTVITLADWYHVAAKLGPAFPPRSDATLINGLGRTSDTPNADLAVITVTTGKRYRFRLISLSCDPAYTFSIDNHDMTIIEADGVNTQQLTVDSLQIFAGQRYSFVLEANQKSGNYWVRANPLFGTTGFAGGINSAILRYDDAVPAEPTSEQGTSTKPLKETDLHPLTAMPVPGSAVSGGVDKAINFAFTFNGTNFFINGATFQPPTTPVLLQILSGAQDAKDLLPSGDVYALPSDATIELSFPASTGAPGAPHPFHLHGHTFAVVRSAGSTEYNYDNPIWRDVVSTGTPQAGDNVTIRFRTDNPGPWFLHCHIDFHLEAGFAVVMAEDIPDTKL

SEQ ID NO: 1234 - protein, 148 aa, Listeria innocua Clip11262
MTKVMIVYASMTGNTQEIADILGEELEKYDIEVEIEECISVDPEDLLEYDGALIGGYTYDDGQLPDEFVDFYEDMADVDFSGKVCASFGSGDTFYDEYCLTVDLVETRLKEQGATVPVAGLKVDLDPDEEDVVRAESYAKTFVEALKG

SEQ ID NO: 1235 - protein, 148 aa, Desulfovibrio desulfuricans subsp. desulfuricans str. G20
MAKVLIVYGSTTGNTQTTAEIVGTELKNAGHDAVVNDVTAVEAEGLCEGYDAVLFGCSTWGDEEIELQDDFIDLYDELDKAGLSGVKVGCFGCGDSSYQWFCGAVDAIEERAKENGARIICDSLKIDGDPGSCRSEIADWASAVGAAL

SEQ ID NO: 1236 - protein, 520 aa, Phlebia tremellosa
MFSFARSTALVVAGLFVGAIAAIGPVTDFHIVNAAIAPDGISRQAVLAEGTFPGPLITGNKGDNFQINVIDELTNATMLKSTTIHWHGFFQHGTNWADGPAFVNQCPIATGNSFLYNFNAPDQAGTFWYHSHLSTQYCDGLRGPFVVYDPNDPYADLYDVDDDSTVITLADWYHTAARLGGPFPNADTTLINGLGRCGEPGAPVSDLAVINVEAGKRYRMRLVSISCDSWFNFTIDGHDMTIIEVDGVNHETLTVDQIQIFAAQRYSFILEANQPVDNYWIRANPGTGITQGFEGGINSAILRYAGADEVEPTTALVASTSPLAEGDLHPLDNPAAPGQPFPGGVDYALNLNLTFDGPTLKFLINGVSFVPPTVPVLLQILSGAQTAQDLLPTGSVYSLPSNATIELSLPAGPAGGPHPFHLHGHTFSVVQGAGQTVPNYVNPVRRDVVSIGAVPDNVTIRFETNNPGPWFLHCHIDWHLDAGFAVVFAEDIPDIASVSPVLTDWSNLCPIYDALDPSDQ

SEQ ID NO: 1237 - protein, 160 aa, Azotobacter vinelandii
MSVTIVYGSDGGCTKKIASRIASKVNGRALDIKKAQVSDFEDCSLLILGCPTYGDGDLQTDWDEQLELLEEADLDGKTIALFGTGDQENYPGSFVDAIGTLYDIVVEKGANVVGLTDVEGYDFTGSTAVRDGRFVGLALDEDNQSSQTNARITAWLAQLM

SEQ ID NO: 1238 - protein, 477 aa, Camellia sinensis
MGFENAKTNSILSKFATNEEHGENSPYFDGWKAYDNDPFHPLKNPNGLSRWVLQKNELCFDLIKEWVVNNPKASICTAEGANELKNIAIYQDYHGLPEFRKGVAKFMGKVRGDRVTFDPDRIVMSGGATGAHEMLAFCLANPGEAFLVPTPYYAGFDRDLKWRTGVELVPVVCESSNNFKVTKSALEAAFKGAKEANIKIKGLLITNPSNPLGTVLDRETLRIIVSFINEKNIHLVADEIYAATVFNTPQFVSIAEILEEIDCNRNLIHIVYSLPKDMGFPGFRVGIVYSYNDAVTSCARRMSSFGLVSTQTQHMIASMLLDDIFVEKFIAKSAERLAKRHELFTKGLAQVGIGSLKSNAGLFFWMDLRRLLEDSTFESEMALWRVIVHDVKLNVSPGSSFHCSEPGWFRVCFANMDDETMRVALRRIRSFVTAKRQCWQSNLKLSLSFRRLDDIGMAPHMMSPHSPISSPLVRART

SEQ ID NO: 1239 - protein, 170 aa, Gloeobacter violaceus PCC 7421
MPEKIRLFYGTTTGKTLDAASMIKDAFGGDTVTLYDISETDKEDLTGAALLIIGCPTWDIGQLQSDWDAFFPVLGDIDFTGKKIAYFGTGDQVGYSENFQDAMGILEAKISERGGTTLGRWPADGYDFNASLAVKNGKFVGLALDDDNQSRLTDKRIKDWVAQLKKEFGV

SEQ ID NO: 1240 - protein, 482 aa, Zea mays
MAASVTVENLNPKVLKCEYAVRGEIVIHAQRLQQQLQTQPGSLPFDEILYCNIGNPQSLGQQPVTFFREVLALCDHPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGALVPYYLNEKTGWGLEISDLKTQLENARSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSAPVREQIYKIASVNLCSNITGQILASLVMNPPKAGDESYASYKAEKDGILESLARRAKALEDAFNKLEGFSCNKAEGAMYLFPQIHLPQKAIEAAKAAKKAPDAFYALRLLESTGIVVVPGSGFGQVPGTWHIRCTILPQEDKIPAVISRFRAFHEAFLAEYRD

SEQ ID NO: 1241 - protein, 507 aa, Cryptococcus neoformans var. grubii
MLPGPVIEANTGDTVIVHVNNYLHEGQGIHWHGLRQNGTALMDGVPGITQCSIPPGGSFTYQFTVSHQSGTFWWHSHYSNSMADGIWGPLIVHSPNEPLQRGRDYDEDRIVAVTDWMHDESETIVEALISSEGYRGRPFPPQGDAILINGRGQTNCTATGSPSCTYPPPPEIHVPVNCRVRLRFISAASHPMYRISIDNHSMEIVETDGTAVYGPTIHEISISSGERYSVIINTTEGKEGDAFWLRTSVALDCMAQGVTQVGLAVVRYTGNGSITTAEPRTEAWTDLARPDTPCVGLDEMYHLSPRELVNASQTALESRVLDSKLGKFVDVYGNSFEGYGFNNVTYQNQINDPLLYVVQRGGTCNSSLIANATFADIGPVNIIINNLDSHIGHPYHMHGTEFQLMGRGTGALTLDDLPNTNLTLDNPTRKDTIWMQGGSWALLRIISDNPGVWALHCHIGWHLAKGKMAVVVVQPEAIKKIQWPESWMDLCANTDPNAFGPARRSVS

SEQ ID NO: 1242 - protein, 728 aa, Coprinopsis cinerea okayama7#130
MITKRSVLSATLSLLAASSTVRSAAVYSKNDYVDNLFGSSSYSDRLASVASARTSPSPAAAASPAVTTSPATLFSAARTFSASTAASSSSVAEAVATTSIASDDSDDNSVDNAGNVGDGNSISGGDDDSASVGSVGDDVAVSSTGDEAAAPEDVDGAAPAPQPSAVIAAGSTSFPFVGSVATLNIGNANLSPDGFERPSSVVNGVFPAPLIKANKGDHFSLNVVNDMTDDTQFRATSIHWHGIYQKHTNWADGVAGVNQCPIGPGDSFLYQFDVPNQAGTFWYHSHFRTQYCDGLRGPLVIYDPEDPYRDLYDVDDENTVITIGDWYHLQSPSITGVASNDATVINGKGRYVGGPLVDLAIINVVPGKRYRLRIMAISCDPNYIFSIDGHQLTVIEADAQSTQPLVVDSIQIFAGQRYSAILTADQPIGNYWIRALPNSGNNNLFTGFIDGTNSAILRYAGAPIADPTTSAPDAPVLLDETLLVPLDTTPVPGQPFPGGADVNLLLNLDFNVDAWRFYVNNETFNPPTVPVLLQVMSGAVAAQDLLPAGSVYTLPPNASVEISIPGGVISSPHPFHLHGHSFSVVKSAGIDTPYNYVNPVKRDVVSTGDVGSNTTIRFFTDNSGPWILHCHIDWHLDLGLAIVLAEDPVGTPALNPTPQDWDDLCPAYDALDPSMTEIAVVATPSPLDPQVVSVPESYLATSTEAEDVTVTVTVTVTEGDDAAATDSS

SEQ ID NO: 1243 - protein, 594 aa, Cryptococcus neoformans var. grubii
MGGIIKLSFLFCSLISLVNSENTGKLPTAISDHSVPKATATTDPSVFVLSNDFEITDVPTTREYTFNLTEALASPDGYERLVYAVNNMLPGPVIEANTGDTVIVHVNNYLHEGQGIHWHGLRQNGTALMDGVPGITQCSIPPGGSFTYQFTVSHQSGTFWWHSHYSNSMADGIWGPLIVHSPNEPLQRGRDYDEDRIVAVTDWMHDESETIVEALISSEGYRGRPFPPQGDAILINGRGQTNCTATGSPSCTYPPPPEIHVPVNCRVRLRFISAASHPMYRISIDNHSMEIVETDGTAVYGPTIHEISISSGERYSVIINTTEGKEGDAFWLRTSVALDCMAQGVTQVGLAVVRYTGNGSITTAEPRTEAWTDLARPDTPCVGLDEMYHLSPRELVNASQTALESRVLDSKLGKFVDVYGNSFEGYGFNNVTYQNQINDPLLYVVQRGGTCNSSLIANATFADIGPVNIIINNLDSHIGHPYHMHGTEFQLMGRGTGALTLDDLPNTNLTLDNPTRKDTIWMQGGSWALLRIISDNPGVWALHCHIGWHLAKGKMAVVVVQPEAIKKIQWPESWMDLCANTDPNAFGPARRSVS

SEQ ID NO: 1244 - protein, 520 aa, Trametes versicolor
  misc_feature (329)..(329): Xaa can be any naturally occurring amino acid
MGRFSSLCALTAVIHSFGRVSAAIGPVTDLTISNADVSPDGFTRAAVLANGVFPGPLITGNKGDNFQINVVDNLSNETMVKSTSIHWHGFFQKGTNWADGAAFVNQYPIARGNSFLYEFTARDQAGTFWYHSHLSTQYCDGLRGPMVVYDPSDPHADLYDVDDETTIITLSDWYHTATSLGAAFPTGSDSTLINGLGRFASGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVXLDSPAAPGDLNIGGVDYALNLDFNFDGTNFFINDVSFVSPTVPVLLQILSGTTSAADLLPSGSLFALPSNSTIEISFPITATNAPGAPHPFHLHGHTFSIVRTAGSTDTNFVNPVRRDVVNTGTAGDNVTIRFTTDNPGPWFLHCHIDFHLEAGFAIVFSEDTADVSNTTTPSTAWEDLCPTYNALDSSDL

SEQ ID NO: 1245 - protein, 462 aa, Arabidopsis thaliana
MSEEQPHANLAVPAFKTEKEPITQTRNGQSSVWRFGGSDKAAKASTVTLRGVIYMLFDNCGKDVNKTILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEKEWEIDLEGIEAIADENTVAMVVINPNNPCGNVYSHDHLKKVAETARKLGIMVISDEVYDRTIFGDNPFVSMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGDALGLKNWVRITIGVEAHMLEDALERLKGFCTRHAKKTETETESLQALKLSDNNLEM

SEQ ID NO: 1246 - protein, 186 aa, Dechloromonas aromatica RCB
MSKIGMFFGTETGTTRLVAKKMQKKLGDEICDKPINVNRITPADMMKYDALILGTPSYGIGEIPGHGASGCFEPNWAEFFDQMPATPDFTGKRIAFFGLGAQERYADRFCSSLFALVEKFKALGAEIVGDWPIDGYTYEQSAAEVDGRFIGLIIDQRTQGMFTDERIDAWLAQVVPLLSEKLTETV

SEQ ID NO: 1247 - protein, 165 aa, Porphyromonas gingivalis W83
MKSIGIFYGSSTGTTSDLAQKIASALGVDSANVMDVANADAAAAAKYDVLLLGSSTWGLGDLQDDWESFLPKLKGENLSGKKVGLFGCGDASSYSDTFCAALGTIKAELANTGCTFIGAYPAEGYSYDETTAEENGQLIGLCVDDANESDQTEARMERWIAAMGL

SEQ ID NO: 1248 - protein, 459 aa, Trametes sp. AH28-2
AIGPKANLVITDAAIAPDGFLRDAIVTNGVFPGPLIKGNKGDRFQLNVIDNLSNHTMLKSTSIHWHGFFQAGTNWADGPAFVNQCPIASGHSFLYDFHVPDQAGTFWYHSHLSTQYCDGLRGPFVVYDPKDPHASRYDVDNGQSSTVITLSDWYHTAARLRPRFPLGADSTLINGLGRSSSTPTADLAVINVQRGKRYRFRLVSLSCDPNHTFSIDGHNLTVIEVDGINSKPLTVDSIQIFAAQRYSFVLNANQPVGNYWVRANPNFGTTGFAGGINSAILRYQGAPNVEPTTTQTPSDIPLIETNLHPLSKMTPGKATIGGVDKALNLGFTFNGTNFFINDATFTPPTVPVLLQILSGAQTAQDLLPAGSVYPLPAHSSIEITLPASAAAPGFPHPFHLHGHAFAVVRSAGSPAYNYADPIWRDVVSTGVPGDNVTIRFRTDNPGPWFLHCHIDFHLE

SEQ ID NO: 1249 - protein, 514 aa, Trametes sp. 420
MSKFQSLVAFVALCLSHSRLVAGAIGPVADLTISNANISPDGFTRSAVVMNNQFPGPLVTGNKGANFQINVIDNLTNDTMLTATTIHWHGFFQKGTNWADGGAFVNQCPISKGNSFLYDFSAPDQAGTFWYHSHLSTQYCDGLRGPMVVYDPSDPHKSLYDVDDDSTIITLADWSHTAARLGPRFPFGGDSTLINGLGRFAGATTTADLAVITVTKGKRYRFRLVSLSCDPNFTFQIQGHSLSVIEADAVNVNPVTADSIQIFAGQRYSFVLNADQDVGNYWLWAVPNIGTVSVSGGVNSAILRYDGADPVEPDAADPSSSNLLQETSLVPLTDVAAPGTAVVGGVDYALNLDFSFDGTDFFVNGATFTSPTVPILLQIMSGAQSAADLLPSGSVFALPANSVVELSFPITATNAPGAPHPFHLHGHTFYVVRSAGSTDYNYVNPPQRDVVSTGTAGDNVTIRFRTDNPGPWFLHCHIDFHLEAGFAVVFAEDVPNVASANTPSCTSCSVSHVR

SEQ ID NO: 1250 - protein, 133 aa, Oryza sativa
GTYVFLFVCNVHEAFAAGAGTQQKNCNHVLIHLQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNL

SEQ ID NO: 1251 - protein, 174 aa, Prochlorococcus marinus str. MIT 9303
MAVGIYFATTTGKTEDIADRLHPLLNGSNTPQDLADLQDLSPLNDLDAIICGIPTWNTGADSERSGTAWDSMLEDISKLSLTGKQVAIYGLGDSSTYTENFCDAIEELHQCFKDAGATMVGYVSKDGYTFEDSKSLIGDKFCGLPLDEDSESDMTDDRLMSWAIQLKQEIPALN

SEQ ID NO: 1252 - protein, 519 aa, Trametes sp. 420
MLQLTSFRRLSLFLFTALATRTFAAIGPVTDLNIVNANISPDGFARDAVLAEGTFPGPLITGQKNDNFRINVVDKLTNTTMLTATSIHWHGFFQHGTNWADGVPFLNQCPIVSGNSFLYNFNVPDQAGTFWYHSHLNTQYCDGLRGALVVYDPADPHASLYDVDEESTVITLADWYHVAAPLAGAVPRSDATLINGLGRWSGDPTSELAAINVTPGKRYRFRLVSMSCDPNYTFQIDGHSMTVIEADGQNTEPLPVDQIQIFAGQRYSFVLEANQTVGNYWIRASPNLVADGGSGFANGINSAILRCDGAPEEEPTTTQDTSINPLREFDLHPLTDPAAPGNPTEGDVGVPINLAIGFSGGNFTVNGTTFESPSVPVLLQILSGAQNAQDLLPSGSVYSLPSNATVELSIPAFAIGGPHPFHLHGHAFSVVRSAGQTEPNYVNPVRRDVVSIGSGTDNVTIRFRTDNPGPWFLHCHIDWHLQAGLAIVFAEDIPETAATNPVPQAWSDLCPEYEASLNA

SEQ ID NO: 1253 - protein, 403 aa, Streptomyces avermitilis MA-4680
MQVIQSTKLANVCYEIRGPVLEEAMRLEAAGHRILKLNTGNPAAFGFECPPEILEDILRNVSSAHGYGDAKGLLAARRAVVMHNQTLGIETDVEHVFVGNGVSELIVMAMQGLLDDGDEVLVPAPDYPLWTASVSLSGGTAVHYHCDEQSDWMPDLADVERKVTDRTKAIVIINPNNPTGAVYDEAMLRGLTDIARRHNLLVCSDEIYDKILYDGATHTPTAAVAPDLLTLTFNGMSKAYRVAGYRVGWMAISGPRAHADSYIEGLTILANMRLCANMPGQHGVVAALSGRQTINELVLPGGRLKEQRDVAHELLTQIPGVSCVKPKGALYLFPRLDPKVFKIKDDRQMVLDLLRREKIMVVQGTGFNWPDPDHFRVVTLPTVGDLTSAITRIGNFLDGYSQP

SEQ ID NO: 1254 - protein, 519 aa, Trametes sp. 420
MLQLTSFRRLSLLLVTALATRSFAAIGPVTDLNIVNANISPDGFARDAVLADGTFPGPLITGQKNDNFQINVVDKLTNTTMLTATSIHWHGFFQHGTNWADGVPFLNQCPIVSGNSFLYNFNVPDQAGTFWYHSHLNTQYCDGLRGALVVYDPADPHAGLYDVDDESTVITLADWYHVAAPLAGAVPRSDATLINGLGRWSGDPTSELAVINVTPGKRYRFRLVSMSCDPNYTFQIDGHSMTVIEADGQNTEPLPVDQIQIFAGQRYSFVLEANQTVGNYWIRASPNLVADGGSGFAHGINSAILRYDGAPEEEPTTTQDTSINPLREFDLHPLTDPAAPGNPTEGDVEVPINLAIGFSGGNFTVNGTTFESPSVPVLLQILSGAQNAQDLLPSGSVYSLPSNATVELSIPAFAIGGPHPFHLHGHAFSVVRSAGQTEPNYVNPVRRDVVSIGSGTDNVTIRFRTDNPGPWFLHCHIDWHLQAGLAIVFAEDIPETAATNPVPQAWSDLCPEYEASLNA

SEQ ID NO: 1255 - protein, 557 aa, Ralstonia solanacearum GMI1000
MRPIISTPAGTSSLAIPDTPGADEAQRADPFQPASRPRSRHPQFERLPSPPVRTRSQELRAARLRRCASDVSATPEARPRLVVVSNRLIDPQRPAAGGLAVALGDMMRDTDGLWFGWSGKTVDEPDTACVRTEPFGRTTLAQVDLGRTDYEGYYAGFSNSVLWPIFHERVKWADLNPAYFKAYEAVNRILASHLRPMLRDSDILWVHDYHLIPFAQALRALGCTQRMGFFNHIPLPSPDVIRRIPQHRQLMRALASYDLVGMQSPRDVLNLQRYWDAENIAAQSERRHDSVHAFPIGIDVESLRALVPSPASQAVIDEVRGAAGRCVLMIGVDRLDYSKGIPTRLKAFRQLLQTHARMRSKVTLVQIAAPTRQSIPAYARLRDKTEQLVREINRRFGTGDWTPVMYFSESVDRTALPQLYRMSRVGVVTPVADGMNLVAKEYVAAQAARDPGVLVLSRGAGAASQLRDALLVPSKNRAATADAYAQALSMPLEERKARHAGLMRNIETEDLRWWRDNYLKALACAPWPAGPEGAEDTRPDAGGASVSGASDGGLTQA

SEQ ID NO: 1256 - protein, 563 aa, Trametes sp. 420
MGKLQSFTALVVLLFSSANRAVAAIGPVADLTISNADVSPDGFTRAAVVMNGQTPGPLITGNKGDDFQINVIDSLDNDTMLTPTTIHWHGFFQKGTNWADGAAFVNQCPISTGNSFLYDFTATDQAGTFWYHSHLSTQYCDGLRGPLVVYDPDDPHASLYDVDDDTTVLTVSDWYHTAARLGTQFPTADSTLINGLGRFAGGDADSALAVVNVTQGQRYRFRLLSLSCDPNHIFTIQGHNFTVIEVDGVNVEPVTVDSIQIYAGQRYSFVLTADQDVDNYWIQAVPNTGTVATTGGVNSAILRYSGAEEIEPDAADQSSTNLLAETDLVPLENLAAPGDASEGGVDYALSLDFDFVLRNGTAFFINGDSFTPPSVPVLLQIMSGTQSAADLLPSGSVYTLPSNATVEISFPMTSTNAPGAPHPFHLHGHTFYVVRSAGSSDYNYVNPPQRDTVSAGTAGDNVTIRFTTNNPGPWFLHCHIDYHLEAGFAIVLSEDTEEAASLNTASCKCRRGCWFNFHGSVLMLLYRSCLGRPVPRLQRCLPRRHLSIINCGTRRDAEGYTPL

SEQ ID NO: 1257 - protein, 574 aa, Brassica juncea
SMSVIVWWLATMVMVAVHSASAGVVELNWEVEYKLGWPDCKEGIVIAINGEFPGPTINAVAGDTVIVHVTNKLSTEGVVIHWHGIRQNGTPWADGAAGVTQCPINPGETLTYNFIVDKAGTHFYHGHYGMQRSAGLYGMMIVRSPKETLQYDGEFNLLLSDWWHQSSHAQELYLSSRPMRWIGEPQSLLINGRGQFNCSLAAYFNKGGLKECKFKENDECAPSILRVEPNKVYRLRIASTTALASLNFAVEGHQLEVVEADGNYIAPFTVDDIDLYSGETYSVLLRTHNPTPSRNYWISVGVRGRKPNTTQALTVLHYAGAPEFEHLPHPPPVTPRWDDYDRSKSFTNKIFAAKGYPPPPEKSDEQLFLLNTQNLMDKYTKWAINNVSLSVPATPYIGTIRYGLKTLNYQKPPGKEIMRDYDITKPPVNPNTTKGSGIYNLQSGRVVDVILQNANVLKGRGSEIHPWHLHGHDFWVLGYGEGKFRLGVDEKTYNLKNPPLRNTVALYPYGWTALRFLTDNPGVWFFHCHIEPHLHMGMGVVFAEGVDKIAKMNIPDQVLGCGSTREFLMNRGRH

SEQ ID NO: 1258 - protein, 173 aa, Photobacterium profundum SS9
MKIGLFYGSTTCYTEMAAEKIRECIGDELVELHNIKETPISEMNNFDMLIMGISTWDFGELQEDWEAVWEQLDGLTLTGKTVAFFGMGDQEGYTEWFLDAMGMLHDKLLPTGINVVGYWPNNESYQFEASKALTEDEEFFVGLALDEDSQFEMSDERITQWCEQILTEYSDSL

SEQ ID NO: 1259 - protein, 169 aa, Anabaena sp.
AKKIGLFYGTQTGKTESVAEIIRDEFGNDVVTLHDVSQAEVTDLNDYQYLIIGCPTWNIGELQSDWEGLYSELDDVDFNGKLVAYFGTGDQAGYADNFQDAIGILEEKISQRGGKTVGYWSTDGYDFNDSKALRNGKFVGLALDEDNQSDLTDDRIKSWVAQLKSEFGL

SEQ ID NO: 1260 - protein, 574 aa, Brassica juncea
WWIVAVAILAHTASASVREYHWEVEYKFGFPDCKEGMVMAINGKFPGPTIHALAGDTIVVHLTNKLATEGLVIHWHGIRQLGSPWADGAAGVTQCAITPGETFTYRFTVEKPGTHFYHGHYGMQRSAGLYGSLIIDAAKGKREPLRYDGEFNLLLSDWWHESILSQELGLSAKPMRWIGEAQSILINGRGQFNCSLAAQFSNATAQFSNTSLPMCKFKKGDQCAPQRLHVQPNKTYRIRLASTTGLASLNFAVQGHKLMVVEADGNYITPFATSEIDIYSGESYSVLLTTDQDPSQNYWISVGVRGRKPKTPPALTVLHYVTAPSSQPHSSPPPETPRWNDFDRSKSFSRKILAAMGSPPPPRKFKKRLILLNTQNTIDGATKWALNNVSLVVPATPYLGSGKYRLRRGFDRKSPPTTFPVDYDIMNPPRNRNTTKGNGIYVFPFNVTVDVILQNANGLDANASEIHPWHLHGHDFWVLGYGEGKFRPGVDEKTYNLKNPPLKNTVALFPYGWTALRFVTDNPGVWFFHCHIEPHLHMGMGVVFAEGLNRIGKIPDEALGCGLTKQFLMNRNNP

SEQ ID NO: 1261 - protein, 169 aa, Anabaena sp.
AKKIGLFYGTQTGKTESVAEIIRDEFGNDVVTLHDVSQAEVTDLNDYQYLIIGCPTENIGELQSDWEGLYSELDDVDFNGKLVAYFGTGDQIGYADNFQDAIGILEEKISQRGGKTVGYWSTDGYDFNDSKALRNGKFVGLALDEDNQSDLTDDRIKSWVAQLKSEFGL

SEQ ID NO: 1262 - protein, 573 aa, Brassica juncea
WIVAVAILAHTASASVREYHWEVEYKFGFPDCKEGMVMAINGKFPGPTIHALAGDTIVVHLTNKLTTEGLVIHWHGIRQLGSPWADGAAGVTQCAITPGETFTYRFTVEKPGTHFYHGHYGMQRSAGLYGSLIIDAAKGKREPLRYDGEFNLLLSDWWHESILSQELGLSAKPMRWIGEAQSILINGRGQFNCSLAAQFSNATAQFSNTSLPMCKFKKGDQCAPQRLHVQPNKTYRIRLASTTGLASLNFAVQGHKLMVVEADGNYITPFATSDIDIYSGESYSVLLTTDQDPSQNYWISVGVRGRKPKTPPALTVLHYVTAPSSQPPSSPPPETPRWNDFDRSKSFSRKILAAMGSPPPPRKFKKRLILLNTQNTIDGATKWALNIVSLVVPATPYLGSVKYRLRRGFDRKSPPTTFPVDYDIMNPPRNRNTTKGNGIYVFPFNVTVDVILQNANGLDANASEIHPWHLHGHDFWVLGYGEGKFRPGVDEKTYNLKNPPLKNTVALFPYGWTALRFVTDNPGVWFFHCHIEPHLHMGMGVVFAEGLNRIGKIPDEALGCGLTKQFLMNRNNP

SEQ ID NO: 1263 - protein, 444 aa, Bifidobacterium longum NCC2705
MQKFSNMPLSEVASAAVPAARRVAVPTAKPASLSAEALNIPRSGIRDVFDRVERVPDAISLTVGEPSATAAPHIVAAACEAAQAGRTRYTNVLGVPEYRKAVADYSARVKGLTYDPETEIQAVDGATIGLFLALKAVVGTGDEVIIPSPFFTSYDAEVMLCGGRPVTVALRPEHGMRVNAADIEAAITPRTRAVIINSPGNPTGAVTSAAELARIAEVCKQHNIWAISDEVYHPFVFGETFGETLGGEAAVAPSIAAVPGMKDRTIVVESLSKTYAMTGWRIGYLLAPEAVIEQTGKIAELMHSSVNSLAQYAGVAALAGPQDHVAAMREEYRAKRQIVLDGLAGCPVLRLIEPQGAFYAFVDVRLTGLDSGEFADRLLDEEHVAVVPGEAFGEEGRGFVRLSYAGDAGELREGVARLRAFAERVWNPITGHHTATYHPMEVLA

SEQ ID NO: 1264 - protein, 384 aa, Staphylococcus aureus subsp. aureus MRSA252
MKLSLNSNSKFLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPIFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPNIKHITDDDFEFCVDLLESTHLAIVPGSSFTEFGKGFVRISYAYEMDVLKEGMKRLAKYLNTK

SEQ ID NO: 1265 - protein, 533 aa, Pleurotus eryngii
MAVAFIALVSLTLALVRVEASIGPRGTLNIANEVIKPDGFSRSAVLAGGSYPGPLIKGETGDRFQINVVNKLADTSMPVDTSIHWHGIFVRGHNWADGPAMVTQCPIVPGHSFLYDFEIPDQAGTFWYHSHLGTQYCDGLRGPFVVYSKNDPHKRLYDVDDESTVLTVGDWYHAPSLSLSGVPHPDSTLFNGLGRSLNGPASPLYVMNVVKGKRYRIRLINTSCDSNYQFSIDGHAFTVIEADGENTQPLQVDQVQIFAGQRYSLVLNANQAVGNYWIRANPNSGDPGFANQMNSAILRYKGARNVDPTTPERNATNPLREYNLRPLIKEPAPGKPFPGGADHNINLNFAFDPATVLFTANNYTFVPPTVPVLLQILSGTRDAHDLAPAGSIYDIKLGDVVEVTMPALVFAGPHPMHLHGHSFAVVRSAGSSTYNYENPVRRDVVSIGDDPTDNVTIRFVADNAGPWFLHCHIDWHLDLGFAVVFAEGVNQTAVANPVPEAWNDLCPIYNSSNPSKLLMGTNAIGRLPAPLKA

SEQ ID NO: 1266 - protein, 170 aa, Gloeobacter violaceus PCC 7421
MPAKIGLFFGTTTGKTGDAAEVIQQELGKTQVDLRDIGRASKADLTAYEYLIIGCPTWNIGDLQDDWDSFYPDLDQINFAGKKVAYFGTGDQRGYGDNFQDAMGILEEKISQRGGTTVGYWPADNYDFNASKAYKNGKFVGLALDDDNQPEQTERRIKQWVAQLKREFGI

SEQ ID NO: 1267 - protein, 518 aa, Schizophyllum commune
MRVSLIIALVYVPISLALGPVGNLPIVNKEIAPDGFSRPTVLANGKFPGELIKGTKGNTFKINVQDQLNDTRMLRSTTIHWHGFFQKNSNWADGPAGVTQCPIATGDSFVYEFGVPDQAGTFWYHSHLSTQYCDGLRGAMVVYDPADPHRSRYDVDDDNTVITLADWYHALAPTIIGVGTPDSTLINGKGRYNGGSLTNLTRINVVRGLRYRLRIVSLSCDPSFTFAIHGHNMTIIEADGVNTQPLVVDSLEVFAGQRYSVVVHANQRIGNYWIRANPSFGTIGFAGGLNSAVLHYIGASSSEPAEVDTEPVSSSPFVETALRPLENPGAPGLPQQGGADVNINLAIDLTLDPFQFTVNGAPFIPPSLPVLLQVMSGARTAQELLPEGSVYTLPPNQTVEISIPGGSAGAPHPFHLHGHTFDVVRSAGSTDYNYANPIRRDVVNTGLAGDNTTIRFRTDNSGPWILHCHIDWHLDIGLAVVMAEDTDGMAQSVQPTAYSDLCPKYDALSDEELGGLVD

SEQ ID NO: 1268 - protein, 484 aa, Nicotiana glutinosa
MVFISSNNQKQQLLSKIATNDGHGENSAYFDGWKAYENDPFHLINNPNGVIQMGLAENQLCFDLIQEWVVNNPKASICTIEGAENFKDIAIFQDYHGLPEFRQAVARFMENVRGDRVTFDPNRIVMSGGATGAHETLAFCLANPGDAFLVPTPYYPGFDRDLRWRTGVQLFPVVCDSSNDFKVTKKALETAYEKAQESNINIKGLLINNPSNPLGTLLDSDTLRDIVKFINSKNIHLICDEIYAATVFDQPKFISVSEIVEEHVGCNKDLIHIVYSLSKDMGFPGFRVGIVYSYNDTVVNIARKMSSFGLVSTQTQHLIASMLSDEIFVEKFIAESSERLGKRHGMFTKGLAQVGISTLKSNAGLFFWMDLRRLLKEPTFDSELELWRIIINEVKLNVSPGCSFHCSEPGWFRVCFANMDDETMRIALRRIRNFVLQTKGLNNKAAVKKQCSRSKLQISLSFRRMDDFMNSPVHSPMNSPLVRT

SEQ ID NO: 1269 - protein, 521 aa, Pleurotus sapidus
MVLSTKLAALVASLPFVLAATKKLDFHIRNDVVSPDGFERRAITVNGIFPGTPVILQKNDKVQINTINELTDPGMRRSTSIHWHGLFQHKTSGMDGPSFVNQCPIPPNSTFLYDFDTAGQTGNYWYHSHLSTQYCDGLRGTFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVNANQTIDNYWIRAPLTGGNPTGNPNLDVSLIRAILRYKGAPAVEPTTVATTDGHKLNDADMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRTSNSDVVNLVNPPRRDVLPINGGNTTFRFFSGNSGAWFLHCHIDWHLEAGLAVVFAERPAEVNDGEQAQIVTQDWRTLCPAYDGLAPEFQ

SEQ ID NO: 1270 - protein, 472 aa, Burkholderia thailandensis E264
MSRLIVVSNRVAAGQDARPTAGGLAVGVLDALKETGGVWFGWNGEIAGAPEEPAIERDGNVTYATVGLTRRDYDQYYRGFSNATLWPVFHYRGDLARFDRQEYAGYLRVNCALAKQLRALVQPDDIIWVHDYHLLPFAHCLRELGVKNPIGFFLHIPFPSPEVLRTVPPHEELMKFMCAYDVVGLQTEGDKQAFVDYIERRGLGTSSEDGILHAHGRVVKVAAYPIGIYPDAIGKAAVEYGSRKAVKALRDTMRERKLVISVDRLDYSKGLVERFQAFERMLANAPGWQGRVSLVQIAPPTRSDVQTYQRIRQTLEGEAGRINGRFAQLDWTPIQYLNRKYERNLLMALFRLSQVGYVTPLRDGMNLVAKEYVASQDPNDPGVLVLSEFAGAAAELPGALLVNPFDLSQMAESLERALAMPLEERQARHAENIARLRKNDLSVWRDSFLADLRSVATAASVTQRAGRRVANA

SEQ ID NO: 1271 - protein, 817 aa, Physcomitrella patens subsp. patens
MLIVGHMLPLTASRGPDEQGWTFTWDEDSLALQLKAGLPKDMEVIYIGCLKVEVDDSEQDEVAATLLENFNCVPAFLPLEVRSRFYHGFCKQMLWPLFHYMLPLSPEHGGRFNRSFWQAYVSVNKVFADKVMEVISPDDDYVWIHDYHLMVLPTFLRKRFNKVRLGFFLHSPFPSSEIYRTLPVRDEILRALLNADLIGFHTFDYARHFLSCCSRMLGLEYESKRGYIGLEYYGRTVGIKILPVGIHMEQLNAGLRLADTEWRIAELRAEFKDRTVLLGVDDMDIFKGIGLKLLALEQLLRQHPKTRNRVVLVQIANPARGRGRDIEDLQNEAYTIAQRINDEFGNDDYQPVVLLERPVALYERIAYYTIAECCVVTAVRDGMNLIPYEYIACREGSPELDAGVDRGPCPAPLKKSMLIVSEFIGCSPSLSGAIRVNPWNIEALAEAMNMSITLPDIEQQMRHEKHFRYVNTHDVAYWARSFMTDLVRTCKGHARRRCYGIGFGLGFRVVALDPDFRRLRTDLIVSAYKKSTSRAILLDYDGTMIPQASINNPMPTPEVLSILNTLCSDRKNFVVIVSGRPRQILNECFSTCKRLGLAAEHGYFYRWHQDIDWVTCRYQRDDFDEYENDRMEWKEIVEPVMQQYTESTDGSYIEEKESAMVWHHRDADPDFGSWQAKELQDHLDSVLANQPVSVKSGAHIVEVKPQGVSKGVVVEELLAMMALKSAAPDFVLCIGDDRSDEDMFESIATVTARSGLAEVFACTVGQKPSKAKYYLDDIAEVIKLLQGIAAASDPGATPASLPTATSSQVSLETSLHI

SEQ ID NO: 1272 - protein, 405 aa, Streptococcus mutans UA159
MMKEFNKSAKLEHVAYDIRGPVLEEADRMIANGEKILRLNTGNPAAFGLTAPDEVIRDLIMNARESEGYSDSKGIFSARKAIMQYCQLKNIPDVDVDDIYIGNGVSEMITMSMQGLLDDGDEVLVPMPDYPLWTAAVSLAGGQAVHYVCDESSNWYPDIDNIKSKITSNTKALVVINPNNPTGALYPKDVLEDIVEVARQNDLIIFADEIYDRLVMDGGEHVAIASLAPDLFCVSMNGLSKSHRIAGFRVGWMVLSGPKKHVKDYIEGLNMLSNMRLCSNVLAQQVIQTSLGGVQSIDELLLPGGRIYEQRNFIYKAMNEIPGITAVKPQAGLYIFPKIDRNMYRIDDDEQFVLNFLKQEKILLVHGRGFNWMEPDHFRIVYLPRVEELSKIQEKMTRFLGQYRK

SEQ ID NO: 1273 - protein, 749 aa, Solibacter usitatus Ellin6076
MRRMVPFTLALLAGLALLAWAASGVVQTTARRWFERDIGARANLVLVSSEKSLANNWNGEPGELQKQLAALTRDERVMGAAACDPDLKTRAATVGFPEDFGCWAVGTRVRSIDSNGVAHFRPWSTVSDLPTGRVHVSVMPLANPAGQELGFAILLHDLSFIDRREAQARTFLFATFGILAFIALLLPVWVARLARYDWSRELSSLLRGGGKQQQSREFQPILSDVRELVSRMAYDRDDAPGQWNAERLKHSLNSNLHGERVVILSNREPYIHEFTPHGGIEVQHPASGLVTALEPVMRACSGVWVAHGSGSADRETVDRKDHVRVPPGEESYHIRRVWLTEEEQQGYYYGFSNEGLWPLCHVAYARPIFRAEDWRQYRAVNQKFADAVLSEVDSSDPIILVQDYHFALVPAMIRKRLPAATVIMFWHIPWPNAENVGICPWRNQLLEGLLGSSILGFHTQLHCNNFLDSVDRYLETRIDRENNAVVMQGHRTLIRPYPISLEWPVHWAVEAPSPEDCRAQVWRDLGLKRDALLGVGIDRLDYTKGIEERLLAVEQLLERYPEYRGRFSFAQLAAPSRTKIERYRQLSEDVERLAERINQRFGKPDYRPVILLRSHHEPPEVFRYFRASDLCYVSSLHDGMNLVAKEYVAARTDLKGVLVLSEFTGAARELSEALIVNPYDLEASSDALAAALAMPLEEQRDRMASMRSLLVQFNVYRWAGRMLVDAARLRNQERVAGRLAERTGVGSSA

SEQ ID NO: 1274 - protein, 445 aa, Desulfotalea psychrophila LSv54
MPLRKKQWGEDMRTDIVHIGAGELTYEIRNIVEVGQRLQRLGVEVNWENIGDPIAKGEEVPSWMKALVAEAVQDDASYGYSPTKGVLATRRFIAAETNKKGAVQISAEDIIFFNGLGDAISKIFGFLKRTARVLVPTPSYTTHSSAEAAHSGDKPLTYKLDPHNDWYPDIADIERRVKYNPMVAGILIINPDNPTGAVYPVEILRAIVDIARRYDLFLICDEVYQNIIYNGKKTASLAEVIGEVPGFAMRGASKEMPWPGARCGWIEVYNADRDPMFQRYIDSIFNAKMLEVCSTTLPQIVYPRVVTHAEYPGYLQSRIARYQRFSKIAYDCLKDIEGILVNQANGAFYMSVCFEDGVLNSGQSLAIARDEVRTMVEDLVFSADTALDKRFVYYLLGATGVCVVPLTSFASDINGFRVTLLERDEAEFIRIFTVIAAAIRTYLKS

SEQ ID NO: 1275 - protein, 113 aa, Triticum aestivum
VTLSNKFVQKSRLLPVRNSRDIVDPRVRYLFPQICLPQKAIEAAKAANKAPDAFYALRLLESTGIVVVPGSGFGQVPGTWHFRCTILPQEEKIPAIISRFTVFHETFMAEYRD

SEQ ID NO: 1276 - protein, 1054 aa, Saccharomyces cerevisiae
MTIIVASLFLPYTPQFEADVTNSDTAKLVESSMIKVDCNNQELSNNKQERSSSVTSASSHYIGLPQEAQINGEPLQRANVGSPATGVNYHNEMEMLSSEQFLEELTANATHAANSGIPPANNPVSSGSTAQRPSVEEFFSAPSARVCSPSQEASASSISASRSSAHHNDLSSSLMKNPNLSFDSHLPRVRSSSKSAVITPVSKSVPDVDPAVVDVAKVREEFQQQASLPSMKRVSGSTAGDSSIASSSSNLRYSQQFQDNFIEDTDSEDDIDSDLETDATKKYNVPKFGGYSNNAKLRASLMRNSYELFKHLPWTIVDSDKGNGSLKNAVNIAVAEKTVKEPVSWVGTMGIPTDELPHEVCHKISKKLEQDFSSFPVVTDDITFKGAYKNYAKQILWPTLHYQIPDNPNSKAFEDHSWDYYQKVNQKFSDRIVSVYKPGDTIWIHDYHLMLVPQMVREKLPKAKIGFFLHVSFPSSEVFRCLANRERILEGIIGANFVGFQTKEYKRHFLQTCNRLLAADVSNDEVKYHCNIVSVMYAPIGIDYYHLTSQLRNGSVLEWRQLIKERWRNKKLIVCRDQFDRIRGLQKKMLAYERFLIENPEYIEKVVLIQICIGKSSDPEYERQIMVVVDRINSLSSNISISQPVVFLHQDLDFAQYLALNCEADVFLVDALREGMNLTCHEFIVSSFEKNAPLLLSEFTGSSSVLKEGAILINPWDINHVAQSIKRSLEMSPEEKRRRWKKLFKSVIEHDSDNWITKCFEYINDAWESNQETSTVFNLAPEKFCADYKASKKHLFIFKISEPPTSRMLSLLSELSSNNIVYVLSSFTKNTFEGLYNGVLNIGLIAENGAYVRVNGSWYNIVEELDWMKEVAKIFDEKVERLPGSYYKIADSMIRFHTENAEDQDRVPTVIGEAITHINTLFDDRDIHAYVHKDIVFVQQTGLALAAAEFLMKFYNSGVSPTDNSRISLSRTSSSMSVGNNKKHFQNQVDFVCVSGSTSPIIEPLFKLVKQEVEKNNLKFGYTILYGSSRSTYAKEHINGVNELFTILHDLTAA

SEQ ID NO: 1277 - protein, 404 aa, Pectobacterium atrosepticum SCRI1043
MSPIEKSKKLENVCYDIRGPVLKEAKRLEEEGNKVLKLNIGNPAPFGFEAPDEILVDVIRNLPTAQGYCDSKGLYSARKAIVQHYQARDMRDMTVEDVYIGNGVSELIVQSMQALLNPGDEMLVPAPDYPLWTAAVSLSNGNAVHYLCDESSDWFPDLDDIRKKITSNTRGIVIINPNNPTGAVYSKELLLDIVAIAREHSLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRNRSWELINQIPGVSCVKPRGALYMFPRIDAKRFNIHDDQKLVLDLLLQEKVLLVQGTAFNWPYPDHVRIVTLPRIDELDMAIHKLGRFLGHYHQ

SEQ ID NO: 1278 - protein, 381 aa, Triticum aestivum
EGQVPPDLPSRTAIQQYLQSKNRLLILGFNSTLTEPVESSGRRGGDQIKEMELKLHPDLKGPLRALCEDESTTVIVLSGSDRSVLDENFGEFNLWLAAEHGMFLRPTDGEWMTTMPEHLNMDWVDSVKHVFEYFTERTPRSHFEHRETSFVWNYKYADVEFGRLQARDMLQHLWTGPISNAAVDVVQGSRSVEVRSVGVTKGAAIDRILGEIVHSKSMVTPIDYVLCIGHFLGKDEDIYVFFDPEYPSEPKVKPDGASVSVDRRQNGRPSNGRSNSRNSQARTQKPQVAAPPPERSSSSSDHSTANNNSHHDWREGSSVLDLNGDNYFSCAVGRKRSNARYLLNSSEDVVSFLKEMAESTTPRAGGLPPGAAADYMFLDRQ

SEQ ID NO: 1279 - protein, 414 aa, Triticum aestivum
  misc_feature (14)..(14): Xaa can be any naturally occurring amino acid
  misc_feature (22)..(22): Xaa can be any naturally occurring amino acid
AGNSARGYLGLPQXDRLATTRXFESQFDAYKRANQMFADVVYQHYQEGDVIWCHDYHLMFLPRCLKEHDINMKVGWFLHTPFPSSEIYRTLPSRSELLRSVLCADLVGFHTYDYARHFVSACTRILGLEGTPEGVEDQGKLTRVAAFPIGIDSDRFKRALDIDAAKRHVNELKQRFAGRKVMLGVDRLDMIKGIPQKILAFEKFLEENPEWIDKVRLLQIAVPTRTDVPEYQKLTSQVHEIVGRINGRFGTLSAVPIHHLDRSLDFHALCALYAVTDVALGTSLRDGMNLVSYEYVACQGSKKGVLILSEFAGAAQSLGAGAILVNPWNITEVADSIKHALTMTSDEREKRHRHNYAHVTTHTAQDWAETFVCELNDTVAEALMRTRQVPPDLPNRTAIQQYLQSKNRLLILGF

SEQ ID NO: 1280 - protein, 559 aa, Oryza sativa Japonica Group; identical to SEQ ID NO: 425

SEQ ID NO: 1281 - protein, 140 aa, Brassica napus
LNESTGWGLEISDVKKQLEDARSRGIDVRALVVINPGNPTGQVLAEENQYDIVKFCKNEGLVLLADEVYQENIYADNKKFHSFKKIVRSLGYGEEDLPLVSYQSVSKGYYGECGKRGGYMEITGFSAPVREQIYKIASVN

SEQ ID NO: 1282 - protein, 482 aa, Panicum miliaceum
MAATVAVENLNPKVLKCEYAVRGEIVIHAQHLQQQLQTQPGSLPFDEILYCNIGNPQSLGQQPVTFFREVLALCDHPCLLEKEETKSLFSADAISRAKQILSTIPGRATGAYSHSQGIKGLRDAIAAGIASRDGFPANADDIFVTDGASPGVHMMMQLLIRNEKDGILCPIPQYPLYSASIALHGGTLVPYYLDEKTGWGLEISDLKKQLEDARSKGIDVRALVVINPGNPTGQVLAEDNQCDIVRFCKNEGLVLLADEVYQENIYVDDKKFNSFKKIARSVGYGEDDLPLVSFQSVSKGYYGECGKRGGYMEITGFSAPVREQIYKIASVNLCSNITGQILASLVMNPPKVGDESYAAYKAEKDGILQSLARRAKALEDAFNNLEGISCNKAEGAMYLFPQIHLPKKAIEAAKAANKAPDAFYALRLLESTGIVVVPGSGFGQVPGTWHIRCTILPQEDKIPAVITRFKAFHEAFMAEYRD

SEQ ID NO: 1283 - protein, 566 aa, Camellia sinensis
MGSMKTTFVAAALLLCLLAGASVVRAEDPYLFFEWTVTYGTISPVGVPVQAILINGQFPGPKINCTSNNNIVVNVFNKLDEPFLLTWYGIQQRKNSWQDGTLGTMCPIQPGTNYTFKFQVKDQIGSYYYFPTTGLQRASGGIGGLQVHSRLLIPVPFDAPADEYFVIAGDWYNKGHKSIQKQLDTGRSLGRPDGIQINGKSGKVGGSNEPMFNMEAGKIYRYRVCNVGMKTSLNFRIQGHSLKLVEMEGSHTVQNVYDSLDVHIGQCFSVLVEANQEPNDYYMVFSSRFTKQPLTSVAVIRYANGKNSPSSELPAPPPETATGIAWSINQFRSFRWNLTASAARPNPQGSYHYGKINITRTIKLVNSRNNVDGKLRYAINGVSHVEPTTPLKLVEYYGIQDKVFKYDIIKDEPEAASESNEKIVLAPNVLNATFRNFVEIILENHEKTIQTWHLDGYSFFAVAIEPGRWTPEKRKNYNLVDAVSRHNIQVYPGSWAAIMTTLDNAGMWNMRSEMWERAYLGQQFYFSVLSPARSLRDEYNLPEKTPVCGLVKDLPEPPPYSNSGIF

SEQ ID NO: 1284 - protein, 851 aa, Arabidopsis thaliana; identical to SEQ ID NO: 1157

SEQ ID NO: 1285 - protein, 263 aa, Zea mays
VPYYLDEKTGWGLEISDLKKQLEDARSKGIDVRALVVINPGNPTGQVLAEDNQYDIVKFCKNEGLVLLADEVYQENIYVDNKKFNSFKKIARSMGYGEDDLPLVSFQSVSKGYYGECGKRGGYMEITGFSAPVGDESYASYKAEKDGILQSLARRAKALEDAFNTLEGFSCNKAEGAMYLFPQIHLPHKAIEAAKAAKKAPDAFYALRLLESTGIVVVPGSGFGQVPGTWHVRCTILPQEDKIPAVITRFKAFHEAFMAEYRD

SEQ ID NO: 1286 - protein, 168 aa, Brassica napus
MASTSGSVGGEVTGVPGSPLAKPALPPPRPKSPPEYPDLYGKRREAARVQMLEREIGYLEGEIKFIEGAQPASRCCKEVSDFVVANSDPLIPAQRKNRRHCRFWKWLCSCVPCLSLASFCCCCQSECSCHLRKPKCCNCTSCSCIGSQCCDGSCCSNICCCPKPSCPS

SEQ ID NO: 1287 - protein, 352 aa, Ginkgo biloba
QCPISSGESYTYRFTITGQEGTLWWHAHSSWLRASVYGALIIYPRAGTTYPFTRPHRETPLLLGEWWNRNPIDVVNQATRTGAAPNVSDAFTINGQPGDAYRCSRQDTYRVSVKPGETNLLRVVNAALNTELFFTVANHRLTVVAVDASYTKPYRTNVIMLGPGQTTDVLMVADQRPGRYYIAARAYASGRGVPFDNTTTTAILQYQVGRSSSSSRPLMPRLPFYNDTRTATRFSTVLRSLATREHPVFVPRTVDENFFFTVGLGLIKCPPNRSCGGPNGTRFSASMNNVSFVLPKSAAILQAHYHGINGVFTTDFPVNPPIKFDYTAQNISRRLWSPVRATKAKVLKYNTR

SEQ ID NO: 1288 - protein, 482 aa, Triticum aestivum
  misc_feature (226)..(226): Xaa can be any naturally occurring amino acid
  misc_feature (253)..(253): Xaa can be any naturally occurring amino acid
  misc_feature (270)..(270): Xaa can be any naturally occurring amino acid
MMGRKALDYEELNENVKKVQYAVRGELYLRASELQKEGKRIIFTNVGNPHALGQKPLTFPRQVVALCQAPFLLDDPNVGLIFPADAIARAKHYLSLAPGGLGAYSDSRGIPGVRQEVAEFIQRRDGYPSADENIYLTDGASFSGVMQMLNAIIRNERDGILVPVPQYPLYSAAISLFGGSPVPYYLEEEANWGLDLVSTRQSVAEARSRGFTVRAMVIINPGNPTXGQCLSEANIRELLNFCYQENLGLRCQXIYHPNVYQDEPPFISAXRKVMFDMGPPVSREVQLISFHTVSKGYWGECGQRGGYFEMTNIPPKTVDEIYKVASIALSPNVPGQIFMGLMVNPPKPGDISYLKYSAESKSILESLRRRAQIMTDGFNSCRNVVCNFTEGAMYSFPQIRLPQRAMDVAKSAGKAPDVYYCLKLLEATGISTVPGSGFGQKEGVFHLRTTILPAEEDMPAIMSSFKKFNDSFMEQYQDHSRL

SEQ ID NO: 1289 - protein, 1098 aa, Saccharomyces cerevisiae
MALIVASLFLPYQPQFELDTSLPENSQVDSSLVNIQAMANDQQQQRALSNNISQESLVAPAPEQGVPPAISRSATRSPSAFNRASSTTNTATLDDLVSSDIFMENLTANATTSHTPTSKTMLKPRKNGSVERFFSPSSNIPTDRIASPIQHEHDSGSRIASPIQQQQQDPTTNLLKNVNKSLLVHSLLNNTSQTSLEGPNNHIVTPKSRAGNRPTSAATSLVNRTKQGSASSGSSGSSAPPSIKRITPHLTASAAKQRPLLAKQPSNLKYSELADISSSETSSQHNESDPDDLTTAPDEEYVSDLEMDDAKQDYKVPKFGGYSNKSKLKKYALLRSSQELFSRLPWSIVPSIKGNGAMKNAINTAVLENIIPHRHVKWVGTVGIPTDEIPENILANISDSLKDKYDSYPVLTDDDTFKAAYKNYCKQILWPTLHYQIPDNPNSKAFEDHSWKFYRNLNQRFADAIVKIYKKGDTIWIHDYHLMLVPQMVRDVLPFAKIGFTLHVSFPSSEVFRCLAQREKILEGLTGADFVGFQTREYARHFLQTSNRLLMADVVHDEELKYNGRVVSVRFTPVGIDAFDLQSQLKDGSVMQWRQLIRERWQGKKLIVCRDQFDRIRGIHKKLLAYEKFLVENPEYVEKSTLIQICIGSSKDVELERQIMIVVDRINSLSTNISISQPVVFLHQDLDFSQYLALSSEADLFVVSSLREGMNLTCHEFIVCSEDKNAPLLLSEFTGSASLLNDGAIIINPWDTKNFSQAILKGLEMPFDKRRPQWKKLMKDIINNDSTNWIKTSLQDIHISWQFNQEGSKIFKLNTKTLMEDYQSSKKRMFVFNIAEPPSSRMISILNDMTSKGNIVYIMNSFPKPILENLYSRVQNIGLIAENGAYVSLNGVWYNIVDQVDWRNDVAKILEDKVERLPGSYYKINESMIKFHTENAEDQDRVASVIGDAITHINTVFDHRGIHAYVYKNVVSVQQVGLSLSAAQFLFRFYNSASDPLDTSSGQITNIQTPSQQNPSDQEQQPPASPTVSMNHIDFACVSGSSSPVLEPLFKLVNDEASEGQVKAGHAIVYGDATSTYAKEHVNGLNELFTIISRIIED

SEQ ID NO: 1290 - protein, 588 aa, Arabidopsis thaliana
MANVEADFRTSAVGWNLGSNDDELYTELWKACAGPLVEVPRYGERVFYFPQGHMEQLVASTNQGVVDQEIPVFNLPPKILCRVLSVTLKAEHETDEVYAQITLQPEEDQSEPTSLDPPLVEPAKPTVDSFVKILTASDTSTHGGFSVLRKHATECLPSLDMTQPTPTQELVARDLHGYEWRFKHIFRGQPRRHLLTTGWSTFVTSKRLVAGDAFVFLRGETGDLRVGVRRLAKQQSTMPASVISSQSMRLGVLATASHAVTTTTIFVVFYKPRISQFIISVNKYMMAMKNGFSLGTIIGSGDLSSQWPASKWRSLQIQWDEPSSIQRPNKVSPWEIEPFSPSALTPTPTQQQSKSKRSRPISEITGSPVASSFLSSFSQSHESNPSVKLLFQDPATERNSNKSVFSSGLQCKITEAPVTSSCRLFGFDLTSKPASATIPHDKQLISVDSNISDSTTKCQDPNSSNSPKEQKQQTSTRSRIKVQMQGTAVGRAVDLTLLRSYDELIKELEKMFEIEGELSPKDKWAIVFTDDEGDRMLVGDDPWNEFCKMAKKLFIYPSDEVKKMRSKSLLGDKGTIVNLESDQRTVHV

SEQ ID NO: 1291 - protein, 1250 aa, Aspergillus nidulans FGSC A4
MTVYIASLFLPYTVSFRPPEESQALPSSPLSQHQAPESVSTTPNPAVSLFEKRNKTPNVGLTPGATTDHERIFTSDPNKAADPNRSEYPFPNPDNGYDYEHLTESEAHSPAWGVRTALNQPKPQSAFLASPSILRHQEPLNLSTDSLPKVDGPSSVPPKKHFRKPSGRSHNRKPSFSENEWKITTAEQGNGGLRNAVRAAAETGQLEDKVWVGTLGMPTDALTESTKATISEKLEGEYDCLMVDVSDSDFDGHYTHFCKTILWPVFHYQIPDNPKSKAYEDHSWVYYVKLNQVFAERIARNWRRGDTIWVQDYHLLLVPAMLRKLLPDAQIGFFLHVAFPSSEVFRCLAPRKELLEGMLGANLVGFQTEEYCRHFLQTCSRILSVEATNDGLQLEDRFVNVRKFPIGIDPLSWDKRRKAADVEQWIKTISDRYAGKRLIVARDKIDQVRGIRQKLLSYELFLNTHPEWREKVVLIQVATSTTEQPELEAMISDIVMRINSTHSTLAHQPLVFLKQDLAFPQYLALISVADAMMITSLREGMNLTSHEFVYCQDGKYGAQRYGSLILSEFTGSASVFGNHALLVNPWDYHQCADAIHTALSRSEEKRQQVWTQLHEAVLQNSTSNWVKSFSETLSRVWHEQSSREIMAVPRLPMNKLEDRYRQAKRRLIILDYEGTLASWGSPKSIIVTTPQRAITTLADLTEDPRNVVYVMSARMPEELERLFRLVSGLGLIAENGCFIREPYSETWSKLTNQDQTDAWKTAVRQMLEYYRQRAEGSWIEQRHCSLVFHYEAAEDHAAACRLASECADHINDACANQGVHAILVDGVLVVEATSTNKASAAELAWRSCLKQENDAGRPDFLLAIGDSRDDEPVFRWANKLESAHAVSYAMTVTLGSRSTEARATLTQGVAGTAHGAQFEEAIRVTPLGHNRYSAFLQKSFCIGTVPHGGYTSAVLYRLALVHFATAHPNLYKGEPATPISMHLTFLRRTAEGPAKLRVHDMKLGKRTSSLHVELLQPKDQAQSGTEIDEREMEVKVAGYITVSPASSEVGVSAKTNWELHPKPVSGSRSDGGVDFDRLSKTGRDEAWARQDPPFAQFRKATTQVELYGIDPALKKRKNGIVDQWARLKPEGQLTRWSNEAVVFLTDMFPMALDGFDTMADGRESGSATGGAGPTAKYWFPTVSLSIDFKKRLPPAGEEWLYSRVVTKEVRDGRTDLDVTILDAKGEIVALSTQIGLVVSASRNIGKRARL

SEQ ID NO: 1292 - protein, 520 aa, Trametes hirsuta
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDPHASLYDVDNDDTVITLADWYHTAAKLGPAFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPNFGNVGFAGGINSAILRYDGADPVEPTTTQTTPTKPLNEVDLHPLATMAVPGSPVAGGVDTAINMAFNFNGTNFFINGASFVPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDVNDQ

SEQ ID NO: 1293 - protein, 692 aa, Schizosaccharomyces pombe
GTRNGVRSRPVWLPGPEKGSETIINETRSQQSRWLAYAENVIRPLIHYKYWPSSEVDENEEQWWRDYVKMNHAFADKICEIYKPGDFIIVQDYSLFLVPQLIRNKIDDAVIGFYHHHPFPSSEIARCFPRRRAILRSVLGADFIGFEDYSYASHFISCCSRVLDLEIGHDWVNLNGNKVTVRAITVGIDVPRIIRSSGNVSVSEKLEELNKRYENMKVILGRDRLDELYGVPQKLRSFQRFLRTYPEWRKKVVLIQITISSAFKHPKLLSSIKKLVQAINQEFGTDDYTPVHHVEEQLEPADYFALLTRADALFINSIREGVSNLALEYVVCQRDRYGMVLLSEFTATSAMLHDVPLINPWDYNECAGIISYALSTPLERRKMIERASYKQVTTHTMQSWTSSLIRSLAYKLAATKTDQRIPTLTPEHALSVYSKASKRLFMMDYDGTLTPIVRDPNAAVPSKKLLDNLATLAADPKNQVWIISGRDQQFLRNWMDDIKGLGLSAEHGSFVRKPHSTTWINLAELLDMSWKKEVRRIFQYYTDRTQGSSIEEKRCAMTWHYRKADPREWSFQALECEALLEELVCSKYDVEIMRGKANLEVRPSSINKGGIVKQILSSYPEDSLPSFIFCAGDDRTDEDMFRSLHKNTRINKETSFAVTIGSDKKLSIADWCIETLQMLLISALVWRILLTE

SEQ ID NO: 1294 - protein, 404 aa, Haemophilus somnus 2336
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKQQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLAKFLTHYRQ

SEQ ID NO: 1295 - protein, 176 aa, Zea mays
MAPSVAVENLNPKVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDAIAAGITSRDGFPANADDIFITDGASPGVCIFYFSFSCPGRFMNKHDTTVVSS

SEQ ID NO: 1296 - protein, 756 aa, Glycine max
  misc_feature (9)..(9): Xaa can be any naturally occurring amino acid
  misc_feature (18)..(18): Xaa can be any naturally occurring amino acid
  misc_feature (24)..(24): Xaa can be any naturally occurring amino acid
VHHYYNGYXNNILWPLFXYLGLPXEDRLATTRSFQSQFEAYQKANQMFAAVVNKHYEEGDVVWCHDYHLMFLPQCLKNYNRKMKVGWFLHTPFPSSEIHRTLPSRSELLHAVLAADLVGFHTYDYARHFVSACTRILGLEGTPEGVENQGKLTRVAAFPIGIDSERFIRALDLPQVKEHIKELQERFKGRKVMLGVDRLDMIKGIPQKILAFEKFLEENRDWRDKVVLLQIAVPTRTDVPEYQKLTSQVHEIVGRINGRFGELTTVPIHHLDRSLDFHALCALYAVTDVALVTSLRDGMNLVSYEFVACQDKKKGVLILSEFAGAAQSLGAGAILVNPWNITEVATAIAKALNMPSAEREKRHKHNYEHVKTHTAQEWAETFVSELNDTVVEAQIRTKQVPPRLPTETAVERYLQSNNRLLILGFNGTLTEPVEREGDRFKERELTVHPELKLPLAELCSDPKTTVVVLSGSGRAVLDENFKEYDIWLAAENGMFLNPSKGEWMTTMPEQLNMEWVDSVKHVFDYFTDRTPRSYFEEREASLVWSYRHADAEFGRLQARDMLQHLWTGPISNASVDVVQGSRSVEVRAANVTKGAAIDRILGEIVHSKFMTTPIDYVLCIGHFLTKLQQDEDIYAFFEPELPSIGVGLQRSKGTEGVKFPVERVSSLKNPASRNGAAKSSSQKKGQRPVSNNEKKRNNHVCRGPRRLAPEKISWNVLDLKKENYFSCAVGRTQTNARYTLGSPDEVVAFLKELANV

SEQ ID NO: 1297 - protein, 479 aa, Zea mays
MARRRPMDYEELNEKVKKAQYAVRGELYLRASELQKEGKKIIFTNVGNPHALGQKPLTFPRQVVALCQAPFLLDDPNVGLMFPPDAIVRAKRYLAMAPGGLGAYSDARGIPGIRKEVADFIHKRDGYPSDPELIYLTDGASKGVMQMLNAIIRNERDGILVPVPQYPLYSAIISLFGGSLVPYYLEEEANWNLDFANIRQAVAEARSKGITVRATVIINPGNPTGQCLSEANIRELVRYCYHENLVLLADEVYQQNVYQDERPFISARKVMFDMGPPISREVQLVSFHTVSKGYWGECGQRGGYFEMTNLPPKTVDEIYKVASIVLSPNVPGQIFMGVMVNPPKPGDISYPKFTAESKSILESLRRRARMMTDGFNSCRNVVCNFTEGAMYSFPQIQLPARAIEAAKRAGKAADVFYCLKLLEATGISTVPGSGFGQKEGVFHLRTTILPAEEDFPTIMSSFKKFNDSFMEQYEGYSRM

SEQ ID NO: 1298 - protein, 483 aa, Zea mays
MSYNKAPSITAETINPRVKIIRYAPCGEIVKHAARLEQEIEENPASIPFQEVKTPPLCSKQVLSLCDNPALMDRDEARALFSPCSIRRARRILNSIPSKDTGGYTDCRGIKCLRQVVADGITARDGFPSTADDIFLTDGATSAINLMMQILIRSHEDGILSPLPEYPLYSASIILHGGTMVPYNLTEDNGWGLEIFEVKRCLEEARSAGLTVRAMVVINPGNPTGQVLSVTNQEEIVEFCRKEGLVILADEVYQENIYAENKKFHSFKKVARSLAYDENDLTLVSLHSVSMSYGESGRRGGYMEVSGVAANVKDQIYKVASLTLCPNIAGQILVSLAMDPPKLGDESFESFDKEKEQIRSSFCKRAKTLEKAFSGLEGVTCNKLEGALYLFPRLHLPSAAIRAADFEGVSPDIFYAHRLLDATGIAVVPGSGFHQASGTIHIRCTILPDERKIEAMVARLRAFHKAFMNEFRGSQQVMNDLRR

SEQ ID NO: 1299 - protein, 404 aa, Neisseria gonorrhoeae FA 1090
MDKFPKSAKLDHVCYDIRGPVHKKALQLEEEGNKILKLNIGNPAPFGFEAPDEILVDVIRNLPTSQGYCDSKGLYSARKAIVHYYQNKGLRDITVNDVYIGNGVSELIAMSMQALLNDGDEILIPAPDYPLWTAAATLAGGTVRHYLCDEENGWFPNLADMEAKITSKTKAIVVINPNNPTGAVYSKEILLEIAELARKHGLIIFADEIYDKILYDGAVHYHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYHQ

SEQ ID NO: 1300 - protein, 172 aa, Vibrio vulnificus YJ016
MKIGLFYGSTTCYTEMAAEKMRTILGDDLVEIHNVKECDLAQMADYDLLLLGISTWDFGEIQEDWAAIWHDLTSSPVQGKTIALFGLGDQEGYGEWYLDAMGLLHDELKAVGAEFIGYWPNQGYQFEASKALTEDGSHFVGLALDEDSQYELSDERIETWIEQVLTEFHDKL

SEQ ID NO: 1301 - protein, 496 aa, Methanothermobacter thermautotrophicus str. Delta H
MSELQKRAMRFLEDKNPVIVSNRGPVEFFKENDETVMKRGAGGLVSTLLPLVERFSGVWISSAMTVEDARVASGYPENRVPLPEDDPRFTVSFVIVDRERYESYYSIISNPLLWFVQHYMWNTPYDPQIDDKVYRAWEDGYVHVNKKFGDKVISEIERNEKDSLIMLQDYHLYLCPFFIKKEIGDVFLSHFIHIPWPQRDYFNILPERMRADIIGGLLSNTILGFHIERYCANFFECCEDLGYEVDGDRGIVRNGDEKTLVKSYPISVDPESMERTVSSPTFMEKDEFVRKLKGNMFLIYRTDRADLSKNIIRGFRAYELFLRDHPEFHGKVKFLATGKPTRQQIREYRNYSEEVKDTVEEINEKYGTDEWKPIEYIYRADYELVAAAFKNYDCLIVNPIADGMNIVPKEAAIINREDGALILSERAGCYDELAEHVIGVNPFDIKETADAIYSAMKMSPGKRKKLSEGLKSRVLKRTIYHWINEQFDDFEDLWES

SEQ ID NO: 1302 - protein, 449 aa, Thermus thermophilus
MGLIIVANRAPFRLTPEGLVPAVGGLATALLPVLERRHGVWVAAGEWREKGQAATPRESQVRLEQVFLPEKEWQGYYGGFSNRVLWPLCHYFLERVELRRDFYQDYQRANRRFAERVAQVFREGDTVFVQDYHLLLLPRLLRERIPAKIGFFFHIPWPSSGVFRILPWGRALVEGVLGADLIGFHTPEYVENFLRTAAYYGYQVEENRVRVGERWVRVEAHPLGIDTGRFGELAQDPHIGLHARALKRLAGAERLILGVDRLDYTKGILERLLAYERLLQSYPQWRGRVAFFQIATPSRTSVHAYRELKRRVDEVVGRIMGSFLREDWVPLRYFYQTYTQEELAAFYRAADVALITPLRDGMNLVAMEYAYTTEDGVLVLSNLAGAAEYLKEALLVNPYDLDGMAQALDRALRMPGGERRERLSALKARIEALDVQGWAERFLASLEEG

SEQ ID NO: 1303 - protein, 236 aa, Brassica napus
MSLKALDYESLNENVKNCQYAVRGELYLRASELQKEGKKIIFTNVGNPHALGQKPLTFPRQVVALCQAPFLLDNPNVGMIFPADAIARAKHYLSLTSGGLGAYSDSRGLPGVRKEVAEFIQRRDGYPSDPELIFLTDGASKGVMQILNCIIRNQKDGILVPVPQYPLYSATISLLGGTLVPYYLEETDNWGLDVNNLRQSVAQARSQGITVRAMVIINPGNPTGQCLSEANLREIL

SEQ ID NO: 1304 - protein, 403 aa, Pseudomonas putida GB-1
MQFSKSNKLANVCYDIRGPVLKHAKRLEEEGHRILKLNIGNPAPFGFEAPDEILQDVIRNLPTAQGYSDSKGLFSARKAVMQYCQQKEIEGVTIEDIYLGNGVSELIVMSMQALLNNGDEVLIPAPDYPLWTAAVSLAGGKPVHYLCDEQADWFPDLEDIKAKITPNTKALVIINPNNPTGAVYSKELLLGMLELARQHNLVVFSDEIYDKILYDEAVHISTASLAPDLLCLTFNGLSKSYRVAGFRSGWLIISGPKHHAQSYIEGIDMLANMRLCANVPAQHAIQTALGGYQSINDLVLPPGRLLEQRNRTYELLNDIPGVSCVKPMGALYAFPRIDPKVCPILNDEKFALDLLLSEKLLIVQGTAFNWPWPDHFRVVTLPRVDDLEAAIGRIGNFLKGYSQ

SEQ ID NO: 1305 - protein, 483 aa, Arabidopsis thaliana
  misc_feature (310)..(310): Xaa can be any naturally occurring amino acid
  misc_feature (451)..(451): Xaa can be any naturally occurring amino acid
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLXPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPXAEDEMPEIMDSFKKFNDEFMTQYDNNFGYSKM

SEQ ID NO: 1306 - protein, 383 aa, Arabis procurrens
QCPIRPGGSYTYRFNIEEQEGTLWWHAHSRWLRATVYGALIIRPPLSSPHYPFPVLPKREFTLLLGQWWDRNPMDVLNQAQFTGAAPNVSDALTINGQPGDLYRCSSQETLRFLVRSGETILLRVINSALNQELFFAVANHKLTVVAADASYTKPFSTNVIMIGPGQTTDVLLTADQPPAHYYMAAHAYNSANAPFDNTTTTAILQYKGAPCVTLQGKSQARAISAQLPGFNDTATAAAFTAQMKSPSKVEIPLDIDEDLFFTVGLGLFNCPTPNTQRCQGPNGTRFTASINNVSFVFPKRNSIMQAYYQGNPAGVFTTDFPPVPPLAFDYTGNVSRGLWQPTRGTKAYKLKFMSKVQIILQGTSIVTIENHPMHLHGYDFYI

SEQ ID NO: 1307 - protein, 615 aa, Arxula adeninivorans
MKLLSLVPMALAAVATAKTVEYDFHVNWTTANPDGLYERKVIGINGQWPLPRIEVDKGDRLVVNMYNDMPDRNASIHFHGMYQNGTNYMDGPVGVTQCPVPPGGKFTYNFTVDQNGTYWYHSHVDGQYPDGYRAPFIVHDKNFPYDYDEELVLTMSDWYHDLIDYLNKEEFLTLYNPTGAEPVPQAMLFNDTQKLSVSVKPNTTYLVHLMNIGALGAQYFYIEDHNVTVVEIDGVYTEPAETDILYLAVAQRYTFLLKTKDTTDKNYPMVSIFDENLFDVIPSDLGMNMTNWLEYNSDADHPEADIPWESSVDIEYFDDMDLVPYDHKPLYTNVSKRIELEVVMTNLDNGVNYAFFNNITYTAPKVPTLMTALSAGDLVTNELVYGEYTHTVVVNHLDVVEIVVNNNDAGFHPFHLHGHEFQVVERSPEYEGFVPYNPDNHTDSDFAEYPMRRDTAWVPPNGNMVLRFVADNPGAWFFHCHIDWHLTQGLAMVFVEAPEKLKDMTLPQSHKDTCDAVGMPWKGNAAANDDDFLDLTGQNAQAPDLPAGFTARGIVALVFSCISAFLGMGMITWYGLSDISNTERKVLEREGVISEGEQVDPIDPSTVAHPHHHEN

SEQ ID NO: 1308 - protein, 412 aa, Streptococcus pyogenes SSI-1
MEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 1309 - protein, 423 aa, Xanthomonas campestris pv. vesicatoria str. 85-10
MSTAPQKPLAIRERLSEVRYEIRGELARRARELEAQGRKLIKLNIGNPGAFGFRAPEHLQRAIADDMGRTDPYTHQQGLPEAREAVATAYSRRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLQLVAPAGALYAFPAVVGAAARNFDDHAFALDLMNEEGVLVVPGSSFNVPYRHHFRVTLMPEAGVMRDVFARIDRALARRAEAITKVVPLKPRNVA

SEQ ID NO: 1310 - protein, 179 aa, Dichelobacter nodosus VCS1703A
MSEDIGLFYGSTTGMTEDVAFEIERIAREKHGINLTPINIIDLDDPNDMFLYRKIIIGIPTWNYGEYQDDWELIVDKIAAADLRGTTIALFGLGDQIGYPEYYLDAMGMLGAQFAVQGARFIGAWKKDDSYHFEQSKALTENDYFIGLALDEDGQPEKTTPRLEQWLAQILPEFQKITA

SEQ ID NO: 1311 - protein, 381 aa, Zea mays
MARKPLDYEELNENVKRVQYAVRGELYLRASELQKEGKKIIFTNVGNPHALGQKPLTFPRQVVALCQAPFLLDDPHVGLMFPADAIARAKHYLAMAPGGLGAYSDSRGIPGIRKEVADFIHKRDGYPSDPELIYLTDGASKGVMQILNTIIRNEMDGILVPVPQYPLYSATISLYGGSLVPYYLEEEANWSLDFVNIRQTVAEARSKGISVRAMVMINPGNPTGQCLSEANIKELLQFCYHENLVLLADEVYQQNIYQDERPFISARKVMFDMGPPISSELQVVSFHTVSKGYWGECGQRGGYFEMTNLPPKTVDEIYKVASIALSPNVPGQIFVSETPLDVLFFIHLLFTKPGTPFWNDVCLDSSRDLNLKFSNPNYVNH

SEQ ID NO: 1312 - protein, 482 aa, Zea mays
MAASVTVENLNPKVLKCEYAVRGEIVIHAQRRQQQLQTQPGSLPFDEILYCNIGNPQSLGQQPVTFFREVLALCDHPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGTLVPYYLNEKNGWGLEISDFKTRLEDVRSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSAPVREQIYKIASVNLCSNITGQILASLVMNPPKAGDESYASYKAEKDGILESLARRAKALEDAFNKLEGFSCNKAEGAMYLFPQIHLPQKAIEAAKAAKKAPDAFYALRLLESTGIVVVPGSGFGQVPGTWHIRCTILPQEDKIPAVISRFRAFHEAFLAEYRD

SEQ ID NO: 1313 - protein, 516 aa, Zea mays
MAAAMVRTMSTTAAGTPPVSVATINPKLVWVALICDRIAGRLKVSISVLKCEYAVRGEIVTHAQNLQQELQKNPESLPFDEILYCNIGNPQSLGQQPVTYFREVLSLCDHPALLDKSETHALYSSDAIERAWQILEKIPGRATGAYSHSQGIKGLRDEIAAGIAARDGFHASGDNIFLTDGASPAVHMMMQLLISSESDGILCPIPQYPLYSASIALHGGSLVPYFLNEETGWGLDVDELKKQLEEARSKGITVRALVVINPGNPTGQVLVEENQKKIVEFCKNEGLVLLADEVYQENIYVEDKPFHSFKKIARSLGYTDDDLPLVSFQSVSKGYYGECGKRGGYMEITGFSPDVREQIYKVASVNLCSNVSGQILASLVMNPPKAGDESFESFMSERDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSRLKEFHEKFMDEFRD

SEQ ID NO: 1314 - protein, 333 aa, Glycine max
FQVHNMMQLLIRSENDGILCPIPQYPLYSASIALHGGCLVPYYLDEATGWGLEIPELKKQLEAAKSKGINVRALVVINPGNPTGQVLGEANQRDIVEFCKQEGLVLLADEVYQENVYVPEKKFHSFKKVSRSMGYGENDITLVSFQSVSKGYHGECGKRGGYMEVTGFSAEVREQIYKVASVNLCSNISGQILASLVMSPPKVGDESYDSFMAEKENILASLARRAKTLEDAFNKLEGVTCNKAEGAMYLFPQIRLSEKAIKAAEAANATPDNFYCKRLLNATGVVVVPGSGFGQVPGTWHFRCTILPPEEKIPAIVTRLTEFHEKFMDEFRD

SEQ ID NO: 1315 - protein, 464 aa, Zea mays
MTPCALTVDSLNPKVLALADHLGDNAIARRAQCIQNEIEAEPESHPFREVLALCDYPHLLEQSGTNSLFSSGAIARAREILDLFPGRATGGYSHSQGTEGLRDIIAAGIAARDNFPCNADDIFLTDGAAPPVHMMMHLLIRDKKDGILCPVPSHSLYTSAMLLQGATLVPYFLDESRGWGVSMSDLKKQLDSARSMGVFVRGLVVINPGNPTGHVLVEENQREIVDFCRNEDLVLLADEVYQENIYADEKGFHSFKKIARSMGYGEGDISLVSFHSVSNGYYGECGRRGGYMEVTGFNSDVKKQVYKVVSLSSCSNISGQILMSLVMNPPQVGDESYASYQAERDGVLSSFARCAEAMVRSFNGLEGVTCSEAEGAVFVFPSVRLPKKAVAAAEASNTQPDAFYALRLLETTGIVVVPGSVFGQMHGTWHFRCTVLPHEEKKTMTVIISSFVAFHRAFMEEFRD

SEQ ID NO: 1316 - protein, 91 aa, Glycine max
  misc_feature (61)..(61): Xaa can be any naturally occurring amino acid
TTFCGEDTVLLQSFERARFKRITVKAMVIINPGNPTGQCLSEANLREVLQFLYQKNLSLLXDDVYHTNIYHDERPFIISRNDFIELVPPIS

SEQ ID NO: 1317 - protein, 175 aa, Idiomarina loihiensis L2TR
MSLEIGLFYGSTTCYTEIAAEKIQQAIGEDIVQLFDIKNTPLKEAEQFDILIFGISTWDFGELQEDWESHWDDINDVNLRGKVVALFGMGDQEGYTDWFQDALGMLHDAIANHGCKRIGFWPNQGYEFAASKALTADNTQFVGLSLDEDSQYELSDERIEQWTTQILEEIAEQLG

SEQ ID NO: 1318 - protein, 463 aa, Sinorhizobium meliloti 1021
MSRLVIVSNRVPVPDKGGIAPAGGLAVALKVALEEHGGIWMGWSGRSSGENEPEPLAQLHQGNITYALTDLTDTDVGEYYHGFANRVLWPICHYRLDLAEYGRKEMAGYFRVNRFFAHRLAPLVRPDDVIWVHDYHLIPLAAELRQMGLKNRIGFFLHIPWPPADVLFTMPVHEEIMRGLSHYDVVGFQTDHDLENFAGCLRREGIGDELGGGRFSAYGRVFKGGIYAIGIETAAFAEFAKKALTNKTVRKARESIEHRSLIIGVDRLDYSKGITQRIDAFERFILANPAQQGRVTYLQITPKSRSEVPEYEAMQRTVAEQAGRVNGALGAVDWVPIRYINRSVGRHILAGLYRLGKVGLVTPLRDGMNLVAKEYVAAQDPDDPGVLVLSRFAGAARDLKGALLVNPYDIEGTANAMARALSMPLEERKDRWKTMMDHLLEHDVSRWCRDFLNDLATSPDPSG

SEQ ID NO: 1319 - protein, 403 aa, Pseudomonas fluorescens PfO-1
MQFSKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSLQALLNNGDEVLVPAPDYPLWTAAVSLAGGNAVHYLCDEGADWFPDLADIKAKITPNTKAMVIINPNNPTGAVYSKEVLLGMLELARQHNLVVFSDEIYDKILYDDAVHICTASLAPDLLCLTFNGLSKSYRVAGFRSGWIAISGPKHNAHSYIEGIDMLANMRLCANVPSQHAIQTALGGYQSINDLVLPQGRLLEQRNRTWELLNDIPGVSCVKPMGALYAFPKIDPKVCPIHNDEKFVLDLLLSEKLLVVQGTAFNWPWPDHFRVVTLPRVDDLDMAIGRIGNFLKSYRQ

SEQ ID NO: 1320 - protein, 404 aa, Vibrio campbellii AND4
MQNIGMSSKLDNVCYDIRGPVLKHAKRMEEEGHKILKLNIGNPAPFGFDAPDEILVDVIRNLPTSQGYCDSKGIYSARKAVVQYYQRKGILSLDVEDVYVGNGVSELIVMAMQALLNNGDEMLIPAPDYPLWTASVALSGGKPVHYLCDEGADWYPDLEDIKKKITPKTRGIVLINPNNPTGAVYSRDFLLEVIEIARQHNLIIFADEIYDKVLYDGATHTSVATLTEDVLVMTFNGLSKAYRVCGFRGGWMFLTGPKHLAQGYINGLELLSSMRLCANVPMQHAIQTALGGYQSINELILPGGRLLEQRNRAYELINQIPGVSCVKPKGAMYLFPKIDTKMYNIKNDQQMVLDFLKQEKVLLVQGSGFNWPKPDHFRIVTLPHVEDLEIAISRFERFLTTYSQ

SEQ ID NO: 1321 - protein, 170 aa, Anabaena variabilis ATCC 29413
MSNIGLFFGTQTGNTQTESEIIQKEFGGDSVVTLNDVSQAEPSDFNNYDYIIFGCPTWNVGELQSDWEDFYDELDNIDFTGKKVAYFGPGDQVGYPDTFQDALGILEEKISENGAETVGYWPTEGYEFSESKAVRDGKFVGLALDEDNQSDLTEERIKAWVTQLKLEFGL

SEQ ID NO: 1322 - protein, 737 aa, Pyrobaculum aerophilum str. IM2
MRLIIVSNRLPVVLTVGERGMEIREAVGGLATAVKSFIKATENGKALGFSEVVWAGWSGIKAEQESEDLKSRLREMGLLPVSLTAEEVNFFYEGFCNSTLWPLFHGFTVYTVFESKYWEAYVKVNQKYAETVASVANTGDFVWIHDYHLMLMPAMLREMSPDVSIGFFLHIPFPPAEMYQLMPPPWRTALLDGVLASDLVGFHIHEYVNNFVRAVSKFLGYRTEAGVIYAGRRKVHVGAFPIGIDFDFFYNSSLDPEVAGQIEELRQKLRGLKIIFSIDRLDYTKGVINRVHAWERFLKEHPQWRGKASFILIVVPSRIGVPQYDAMKREIEREVGRINGELGDVNWTPIVYISRFIPTPTLLALYNIADVALITPLRDGMNLVSKEYVATKRDCKGVLILSETAGASHELLEALIVNPNDESGVVEAIAKALTMEPEEQCRRIKAMQEKLRQQNVVKWAVDFLHSLMLAYRENTESFTTSSKLLDREAIEEIVKIFHGARSRLLLLDYDGTLVPHYPYAYQAVPDGELKRLLNSLAFQPNTYVAVVSGRGRDFLEAWLGDLPIYIVAEHGAFIRDPGGNWSQLFPFDTSWKISVRKIMEEFTRLTPGSYIEEKEISLAWHYRNVEPEIGEKAANRLADALTGLLESSPANIIRGVKVVEVRAAGVNKGVAAKLLYDKLRPELVIIAGDDYTDEEMMKALPEAITIKVGKGETSAKYMAPSYRRIRELLQALLTAQR

SEQ ID NO: 1323 - protein, 157 aa, Zea mays
MARKPLDYEELNENVKRVQYAVRGELYLRASELQKEGKKIIFTNVGNPHALGQKPLTFPRQVVALCQAPFLLDDPHVGLMFPADAIARAKHYLAMAPGGLGAYSDSRGIPGIRKEVADFIHLRTTILPAEEDFPAIMSSFKKFNDSFMEQYEGYSRL

SEQ ID NO: 1324 - protein, 495 aa, Saccharomyces uvarum
MTTDNAKAQLTSSSGGNIIVVSNRLPVTITKNSSTGQYEYAMSSGGLVTALEGLKKTYTFKWFGWPALQIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLLSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 1325 - protein, 404 aa, Streptococcus pyogenes M1 GAS
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 1326 - protein, 486 aa, Magnaporthe grisea 70-15
MSSTSRRRLNHDNINPHVKAAKYAVRGELAVKSEEFRAKLTNGDSDLPFKEVISANIGNPQQLDQKPITFFRQVLSILENPLLLDHEDVLLNHLGYKSDVVARAKWLLSKVGSVGAYSASNGAPAIRQSIADFLERRDGFPAKESDIYLSAGASSGVNTLLHVICSDKNSGVLVPIPQYPLYTASLSLLDAQCVPYYLDESKNWGTSMETIRAAHDEAKAKGTDVRAIVVINPGNPTGASLSEEDIRGIIELARAERLVVMADEVYQTNVFVGKFHSFKRVLRQLQKENPDGKYDEVELASLHSVSKGMVGECGHRGGYFELVNFDEKVQAEIYKFVSIMLCAPVIGQCLVELMVNPPKEGEPSYELYKKEYDGIFEGLKARATALHKAFAEMEGVECDTPQGSMYLFPTINVPQKAAAEAEKEGRTPDEFYCMRLLEATGVCVVPGSGFGQKPGTLHLRTTFLAPGTEWVGSIVKFHKEFMDKYR

SEQ ID NO: 1327 - protein, 546 aa, Oryza sativa; identical to SEQ ID NO: 844

SEQ ID NO: 1328 - protein, 154 aa, Bacillus cereus E33L
MLEGDAEVAKILIAYASMSGNTESIADLIKVSLDAFDHEVVLQEMEGMDAEELLVYDGIILGSYTWGDGELPFEAEDFHEDLENIDLSGKKVAVFGSGDTAYELFCEAVTIFEERLVERGAELVQEGLKIELAPEDEEDVEKCSNFAIAFAEKF

SEQ ID NO: 1329 - protein, 485 aa, Zea mays
MTPCALTVDSLNPKVLALADHLGDNAIARRAQCIQNEIEAEPESHPFREIIDCSLSNPQSMGQRPNKFFREVLALCDYPHLLEQSGTNSLFSSGAIARAREILDLFPGRATGGYSHSQGTEGLRDIIAAGIAARDNFPCNADDIFLTDGAAPPVHMMMHLLIRDQKDGILCPVPSHSLYTSAMLLQGATLVPYFLDESRGWGVSMSDLKKQLDSARSMGVFVRGLVVINPGNPTGHVLVEENQREIVDFCRNEDLVLLADEVYQENIYADEKGFHSFKKIARSMGYGEGDISLVSFHSVSNGYYGECGRRGGYMEVTGFNSDVKKQVYKVVSLSSCSNISGQILMSLVMNPPQVGDESYASYHAERHGVLSSFARCAEAMVRSFNGLEGVTCSEAEGAVFVFPSVRLPKKAVAAAEASNTQPDAFYALRLLETTGIVVVPGSVFGQMHGTWHFRCTVLPHEEKKMTVIISSFVAFHRAFMEEFRD

SEQ ID NO: 1330 - protein, 947 aa, Arabidopsis thaliana
  misc_feature (61)..(61): Xaa can be any naturally occurring amino acid
  misc_feature (89)..(89): Xaa can be any naturally occurring amino acid
  misc_feature (105)..(105): Xaa can be any naturally occurring amino acid
MPGNKYNCSSSHIPLSRTERLLRDTELTEKRKSNRARNPNDVAGSSENSENDLRLEGDSSXRQYVEQYLGKGLLLAMAPRWMPVERQQXVRPYNRQRLLVVANRXLPVSAVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVIQHMKELKERFAGRKVMLGVDRLDMIKGIPQKILAFEKFLEENANWRDKVVLLQIAVPTRTDVPEYQKLTSQVHEIVGRINGRFGTLTAVPIHHLDRSLDFHALCALYAVTDVALVTSLRDGMNLVSYEFVACQEAKKGVLILSEFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSP

SEQ ID NO: 1331 - protein, 173 aa, Salmonella enterica subsp. arizonae serovar 62:z4,z23:--
MNMGLFYGSSTCYTEMAAEKIRDILGPELVTLHNLKDDAPALMEQYDMLILGIPTWDFGEIQEDWEAVWDQLDDLNLEGKIVALYGMGDQLGYGEWFLDALGMLHDKLALKGVKFVGYWPTEGYEFTSNKPVIADGQLFVGLALDETNQYDLSDERIQAWCEQILNEIAEYYA

SEQ ID NO: 1332 - protein, 427 aa, Ralstonia eutropha JMP134
MFAAADAAVFASADIAVKPIQKSNKLNNVCYDIRGPVLEKAKQMEEEGHKIIKLNIGNLAVFGFDAPEEIQQDMMRNLPNSAGYSDSKGIFAARKAIMHYTQQKNIQGVGLEDIYVGNGASELIVMAVNALLNSGDEVLVPAPDYPLWTAAVSLSGGTPVHYICDESNEWMPDPADIRARITPHTKAIVIINPNNPTGALYSDELLLEIVAIAREHGLIIFADEIYDKVLYDGNVHTSIASLSTDVLTVTFNGLSKNYRSCGYRAGWMVVSGDKRPALDYIEGLNMLSSMRLCANVPGQWAIQTALGGYQSINDLVAEGGRLRRQRDLAYELITAIPGVSCVKPKAALYLFPKLDLSMYPVQDDQEFIYELLQESKVLLVQGSGFNWDKPDHFRIVFLPHEEDLREAINRIARFLEAYRKRHGKVAA

SEQ ID NO: 1333 - protein, 405 aa, Kineococcus radiotolerans SRS30216
MKLEQSDKLADVLYDVRGPALRRAQQLEEAGHRILKLNIGNPAPFGFEAPEELLQDMVANLPVAQGYSDSKGVPSARRAVVQSSQLKGVPGVDVNDVYMGNGVSELIVMTMQALLNDGDEVLVPAPDYPLWTAATSLAGGRAVHYLCDESAGWEPDLDHLRAQVTPRTKAMVVINPNNPTGAVYGKAVLEGMLQVAREHGLLVLSDEIYDKILYDDAVHVSTASLAPDLLCITFNGLSKAYRVAGFRSGWMYLSGPKGHAAGFVEGLDLLANMRLCANVPAQHVVQAALSGHQSINDLVLPGGRLAEQSHRTWELLNQIPGVSCVKPRGALYCFPRLDPEVHRVEDDYQLIVDLLESQHVLVVQGTGFNWPKPDHFRIVTLPRVEDLESAVGRIGTFLTGRLAGR

SEQ ID NO: 1334 - protein, 566 aa, Gossypium arboreum
MGLQQGLVTWFVGVLFLSTLLLSNADVHHYEFFVRESNFTKLCNTTTLLVVNDSYPGPEIRVHRGDTVFVNVHNQGNYGFTIHWHGVKQPRNPWSDGPEFVTQCPIQPGTNFTYEIVLSDEIGTLWWHAHSDWTRGSVHGAFVILPAKKETYPFPTPDADQTIILESWYDGDYKQIIDDALAAGVSPRQPSAYAISGHVGDTYGCPNDTIFRMQVDSEKIYLLRIINAAMNEHFFFTIANHTLTVVAQDASYVRRFTRDYILISPGQTMDVLVSANRNVGQYYMAIRPFSDSSAAPVDNITTGIFEYTNSEGGLNASLITLPVMNDTDAMINFLNQIRNTKVSQNPRINVPADKDIKRRVFMTLAVNNLPCNTCVVGSRLVASLNNVSYVSPSIDILQAYYNRNMSGVYTEDFPLNPPVIYDFTGNLTNLNTPVEEGTRVIVVNYGEGVEMVLQATQMGAGGSHPIHLHGSSFYWVGTGFGNFNNKTDPRTYNLVDPPLINTVHVPGRRWVAIRFFATNPGVWFMHCHLERHSSWGMDTVLIVRNGKTKKTSIRPPPSTMPRCPGT

SEQ ID NO: 1335 - protein, 585 aa, Gibberella zeae PH-1
MRFGWAVLFTPAVLAATVSYDFTIEWVRADPDGEFERPTIGINGKWPIPRIEANVGDTVLVNARNNLGNQSTSLHFHGLFMNGSNHMDGPSQVTQCAIRPGESFLYNFTITQPGTYWYHSHTESQYPDGLRGPLIIHDPESPFKDQYDEEIIMTISDWYHDQMQTLIPEFMRKGNPTGAEPVPQAALMNETQDLQVDVQPGKTYLLRLANIGAFAGHFFWIEGHNLTIVEVDGAYTKPAPANMVYLSAGQRCSVLITTKENTLDNFPIVSSMDTDLFDVLPEDLNWNVTGWLVYDQQKDLPEPLIVHEFDPYDDMDLVPYDDMARLPEPSKHIELDVVMDNLRDGANYAFFNNITYRAPKVPTLYTALTSGKEATNPQIYGTYTHSFVLEKDEIVQIVVNNRDDGRHPFHLHGHHFQVLHRSEDDVGDFTGSEEFAETPMRRDTVVVRGNGNAVLRFKADNPGVWLFHCHIEWHVTSGLIATFVEDPLALQASLKLPQNHLDACKAGGVPTVGNAAGNKNLLDLTGENVPPPRLPEGFTLKGIVAFTFSTLMGIFGIYTVASYGMKKEKKTPERAPLLAEELPEQ

SEQ ID NO: 1336 - protein, 513 aa, Cryptococcus neoformans var. neoformans JEC21
MPRLSNVYCPKSLLQRQTIQIRSFSQTMSPFKPALTLDTINPAVQAVHYAVRGELAIKADKYVQVLADITHKPLPFEKIVTANIGNPQQQGLDQVPLTYWRQIISLLEYPDLMQKHEQLAKQIYPGDVIERARALHNEIGSTGAYTHSKGVLGIRKRVAKFIEERDGYPADPQNIFLTAGASAGVASILGVALRRGDGCMIPIPQYPLYTATLAYLESEPLPYYLSEADDWSMNHDSLLKSVEEGKKKGIPIKALVIINPGNPTGACLSQEAMEAVVHLCYEEGIVLLADEVYQMNVFDPEQRPFISFKKVLMDMPKEIRESVELVSFHSISKGVSGECGRRGGYFECVNIDKDVMDQVYKMASVTLCPPVSGQIGVDLMVSPPKPGDESYPLWKEETDLIQNNLKSRSYLMAEHFNKMEGVSCNNAEGAMYLFPRINIPPKAVEAAKKLGKEPDVMYALDLLDATGICAVAGSGFGQEPGTFHLRVTALCPDTAEFIGRFQKFNKEFMEKYA

SEQ ID NO: 1337 - protein, 122 aa, Triticum aestivum
  misc_feature (16)..(16): Xaa can be any naturally occurring amino acid
  misc_feature (66)..(66): Xaa can be any naturally occurring amino acid
ERTSGGYFELVGFDPXEVQQEIYKFVSIGLCAPVVAQCLVELMVNPPREGSPSYELYRQEYDGIFXSLKTRAFALYEAFKEMEGVECDEPQGSMYLFPTIKLSSKAVEAAKKEGRSPDEYYA

SEQ ID NO: 1338 - protein, 141 aa, Methanothermobacter thermautotrophicus
MFLREHPEFHGKVKFLATGKPTRQQIKEYRDYADSVKSTVDEINSIYGKSTWKPIEYIHRADYELVAAAFKNYDCLIVNPLADGMNIVPKEAALMNEKSGTVILSENAGCYEELAEYAIGVNPFDMKGNCRCHLQVHNNEL

SEQ ID NO: 1339 - protein, 222 aa, Zea mays
  misc_feature (209)..(209): Xaa can be any naturally occurring amino acid
ESVRLRAELKKGATGLPFPEVISANIGNSQQLDQKPITFFRQVLSLLENPQLLEHEDVLLEKLGYKSDVIARAKWLLSEVSSVGAYSASSGVSGIKESIARFLERRDGIPADPKHIYLSAGASSGVNTLLHIICANKNSGVLVPIPQYPLYTASLSVLDAVCVPYLLDESKAWGTDLDIMRASYEKAKADGVDTRALVVINPGNPTGAXLSEADVRATIQFA

SEQ ID NO: 1340 - protein, 404 aa, Vibrio fischeri ES114
MQNIGMSSKLSSVCYDIRGPVLKHAKRMEEEGHKILKLNIGNPAPFGFDAPDEILVDVIKNLPTSQGYCDSKGIYSARKAVVQHYQRRGLLDLDVEDVYIGNGASELIVMAMQALLNNGDEMLVPAPDYPLWTAAVSLSGGKPVHYMCDEGADWYPDLDDIKKKITPNTKGIVLINPNNPTGAVYSRDFLLQVVEIARQNNLIIFADEIYDKVLYDGAVHTTLATLAPDILTVTFNGLSKAYRVCGFRGGWMFLNGPKDHAQGYIAGLDMLASMRLCANVPMQHAIQTALGGYQSINELLLPGGRLLEQRDKAYDLITQIPGVSCVKPKGAMYLFPKLDPKMYKIKDDQKFVLDFLIKEKVLLVQGTGFNWPTPDHFRIVTLPRVDDLETAIGRLERFLHTYKQ

SEQ ID NO: 1341 - protein, 404 aa, Neisseria meningitidis Z2491
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLDDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKSYRVAGFRQGWMVLNGPKHHAKGYIEGLDMLSSMRLCANTPMQHAIQTALGGYQSINEFILPGGRLLEQRNRAWELVSQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 1342 - protein, 393 aa, Chlamydomonas reinhardtii
MTNMDAPSTSNGTSTSAQDAAAQKQPVRRAPLGIDTINKRVIKSEYAVRGEIVQLAQKIAKEVESGQHNHPFDKVVWCNIGNPQILGQKPITYFRQVLALCECPQLLTKQIPGGLGAYSATLTLYGGTLAPYLLDEGAGWGLDVEHLRLQLAKARREGLCVRAMVVINPGNPTGQCLSYQNMRDVLTFCRDEQLVLIADEVYQANIYVGNKEFFSFKKVACAMGLEDQVPLVSLHSISKGFIGECGRRGGYMEVTGFPEPVKDQILKLASINLCPNLSGQICCALMMNPPQPGEASYELYRKEKSDILGSLKRRAELLVGALNRLEGVSCNAAEGALYAFPRPDWLYCKELLEATGIVVVPGSGFGQADGTFHFRTTFLPSEEDIGRVVWCQP

SEQ ID NO: 1343 - protein, 508 aa, Oryza sativa Indica Group
MATGVSVENINPKVILGPSSIAECIVTNARREINRYLTFFFQHLQQQLQTQPGSLPFDEIVYCNIGNPQSLGQKPITFFREVLALCNHPNLLEREEIKSLFSTDAIARAKKILSMIPGRATGAYSHSQGIKGLRDEIAAGIASRDGFPANADDIFLTNGASPGVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEVYQENIYVTNKKINSFKKIARSMGYNGDDLQLVSLHSVSKGYYGECGKRGGYMEVTGFSTPVREQLYKIASVNLCSNITGQILASLIMDPPKAGDASYDLYEEERDNILKSLSRRAKAMESAFNSIDGITCNKTEGAMYLFPRIYLPQKAIEAARAVNKAPDVFYALRLLDTTGIVVTPGSGFGQIIRCYLFTCNSEFLTTQVWSFVKGCRDMAREMHDPAAGGEDTFDDLPLQGIP

SEQ ID NO: 1344 - protein, 665 aa, Arabidopsis thaliana; identical to SEQ ID NO: 25

SEQ ID NO: 1345 - protein, 636 aa, Saccharomyces cerevisiae
MTNALLSIAVLLFSMLSLAQAETHTFNWTTGWDYRNVDGLKSRPVITCNGQFPWPDITVNKGDRVQIYLTNGMNNTNTSMHFHGLFQNGTASMDGVPFLTQCPIAPGSTMLYNFTVDYNVGTYWYHSHTDGQYEDGMKGLFIIKDDSFPYDYDEELSLSLSEWYHDLVTDLTKSFMSVYNPTGAEPIPQNLIVNNTMNLTWEVQPDTTYLLRIVNVGGFVSQYFWIEDHEMTVVEIDGITTEKNVTDMLYITVAQRYTVLVHTKNDTDKNFAIMQKFDDTMLDVIPSDLQLNATSYMVYNKTAALPTQNYVDSIDNFLDDFYLQPYEKEAIYGEPDHVITVDVVMDNLKNGVNYAFFNNITYTAPKVPTLMTVLSSGDQANNSEIYGSNTHTFILEKDEIVEIVLNNQDTGTHPFHLHGHAFQTIQRDRTYDDALGEVPHSFDPDNHPAFPEYPMRRDTLYVRPQSNFVIRFKADNPGVWFFHCHIEWHLLQGLGLVLVEDPFGIQDAHSQQLSENHLEVCQSCSVATEGNAAANTLDLTDLTGENVQHAFIPTGFTKKGIIAMTFSCFAGILGIITIAIYGMMDMEDATEKVIRDLHVDPEVLLNEVDENEERQVNEDRHSTEKHQFLTKAKRFF

SEQ ID NO: 1346 - protein, 502 aa, Synechococcus sp. PCC 7335
MSMKSSLVILYHREPYDEVEENGKIYYREKKSPNGIVPTLKSFFSNADQSTWVAWKQIKPEQSEGFEERVTMEGGSDSCVVRRIPLNAEQVRNFYYITSKEAFWPILHSFPEHFTYDSSDWENFQNINRLFAEAACEDAADDALIWIHDYNLWLAPLYIREKMPNVKIAFFHHTPFPAADVFNILHWRNAIIDSLLCCDLCGFHIPRYVQNFVSAARSCREVEILETMPVPKAFTRVGTALAEPEMTTKLRYNGRVVNIDAFPVGTNPKNIRKTVLTQEITNRVKEIREQIGDNKLIVSAGRVDYVKGAKEMLQCFERLLERQPIMVGKVNLVMTAVKAAAGMRVYQEAQQTIEQLVGQINGRFSSLGWTPIVLFTEPLPQEDLMALYKTADICWICPLRDGLNLVAKEYVAAHGGEDGVLILSEFTGSAVELPEALLTNPYSSTRMDECIDAALVMSPEEQKQRMAKLYKAICRYDVQQWANHLFREAKATSVQTSASLLS

SEQ ID NO: 1347 - protein, 521 aa, Chlamydomonas reinhardtii
MRKEATRLVSALLRAGNNGVSTSWAVGGTRLKSAMPQPDEKKDEDLHAKEGKVLHPHLLNENVVKTQYAVRGELYLRAEQLRKEGKEIIFTNVGNPHALGAKPLTFTRQVLALCAAPFLLDHPKVEDMFPADAIARAKKILASFKGGVGAYTDSRGNPLVREEVARFIEKRDGVPSNPDHIFLTDGASVAVRLCLNAMIRHDRDSVLVPIPQYPLYSASIRLYGGTLVGYFLDERRGWGLSVEELQRALQEAREEGKLVRGLVFINPGNPTGQCLSKENLQELIKFAYQEKIVLMADEVYQENVYQDERPFVSAKKVMWEMGEPYRSHVELLSFHTVSKGTAGECGLRGGYVEMTNIHPGAIEEVYKCASINLSPNTMGQIALSVLVNPPKPGDPSYDQYTKEKASELVSLRRRAHMVTDGFNALDGVTCNFTEGAMYSFPQIKLPAKALEAAKAAGKAGDVFYCLKLLEATGISTVPGSGFGQEEGTFHLRTTILPREEVMTHFVEKFDKFHKDFMKQYS

SEQ ID NO: 1348 - protein, 473 aa, Salmonella enterica subsp. arizonae serovar 62:z4,z23:--
MSRLVVVSNRIAPPDNKGGAGGLAVGVLGALKAAGGLWFGWSGETGNEDEPLKKVTKGNITWASFNLSEQDYEDYYCQFSNAVLWPAFHYRLDLVQFQRPAWEGYMRVNALLADKLLPLIKENDIIWVHDYHLLPFASELRKRGVNNRIGFFLHIPFPTPEIFNALPPHDELLEQLCDFDLLGFQTENDRLAFLDSLSSQTRVTTRSGKHHIAWGKDFQTEVYPIGIEPDEIALQAAGPLPPKLVQLKAELKNVKNIFSVERLDYSKGLPERFLAYEALLENYPQHRGKIRYTQIAPTSRGEVQAYQDIRHQLETEAGRINGRYGQLGWTPLYYLNQHFDRKLLMKIFRYSDVGLVTPLRDGMNLVAKEFVAAQDPANPGVLVLSQFAGAANELTSALIVNPYDRDDVAAALNRALTMPLAERISRHAEMLDVIVKNDINRWQERFIHDLKEVTPRSAERRQQNNVATFPKLA

SEQ ID NO: 1349 - protein, 409 aa, Alcanivorax sp. DG881
MTSDQYHVSKSDKLKGVCYDIRGPVLREAHRLEDEGHRVIKLNIGNPAPFGFEAPEELLQDVIANLPDSTGYCHSKGLFPARKAVMQYTQTKGIEGVTVDDVIIGNGVSELIVMAMQALLNSGDEVLLPAPDYPLWTASVRLSGGTPVHYLCDEQQDWQPSLEDIRAKVNKNTKALVIINPNNPTGANYEPAMLRELLQIARENNLIVFADEIYDKILYDGEEHTSIASMADDLLFITFNGLSKNYRAAGFRAGWMVISGAKHRAESYIEGLDMLASMRLCANVPSQHAIQTALGGYQSIGDLVLPTGRLGRQRDLAWEMLDSIPGVSCVKPKSALYLFPKLDPKVFPFEDDEAFALDLLREEKVLIVQGTAFNWPDPDHFRVVFLPRPDDLEDSIGRIARYLDRARKK

SEQ ID NO: 1350 - protein, 605 aa, Aspergillus terreus
MPSLKDWVAAGLVPMTIASSTGRLPSNCTNGPSSRRCWQDGFDIWSDYTDPKVAPPGKLVEYDLTVTQVTISPDGYERLGTVFNGQYPGPLIEADWGDTLRITVHNNLTNGNGTAVHWHGIRLFETNWIDGVPGVTQCPIPPGESQVYEFRATQYGTSWYHSHFSLQYSNGLYGPLVIHGPSSSDWDVDLGPWTLTDWYHEDAFTLNWISLAGQLAPIPVSTLLNGKGTYDCDPGLDPACTGKQEYFETTFQQGTKYKMAIVNTATLLTYTFWIDGHNFTVIEVDFVPVEPYSTNVLNVGMGQRYEIVVEANADRTQGSSFWIHAHYCDIPDVIPNNKVGIIRYDESDTSEPATPPLSEQHRDFGCSDPSLGDLVPVVKKTVGPRVNQIGPHDYLTIGEQGKIPTPWEKDPRVHLWTIKNTAMYVDWQTPSLGKLTADHDEEFPPETVPVTLDFDTGEWVYFLLTSNYSLEDVVTPRNLTPSVHPIHLHGHDFAILAQGKGPFTPDIAPQLDNPPRRDVVDVDIGGYAWIAFEVDNPGAWLLHCHLQYHASEGMALQYIEQPSKIKPLIENAGVLNDFENRCASWKRYYNAVDIPNDRPQDDSGI

SEQ ID NO: 1351 - protein, 404 aa, Haemophilus influenzae R2846
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEEANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIRSDEKMVLDLLRQEKVLLVHGKGFNWHSPDHFRVVTLPYVNQLEEAITKLARFLSDYRQ

SEQ ID NO: 1352 - DNA, 11722 bp, Artificial sequence
  Synthetic construct
cgcgcctgcctgcaggtactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagcggaccggtcgcgcctcagcagtcgctgtcgttaacccagcggtactcgctgaggcgatcgcgggcccggtaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgacctgcaggatttaaatccatcgttctggggcctaacgggccaagcttactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatgggggatccactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgg

SEQ ID NO: 1353 - DNA, 9769 bp, Artificial sequence
  Synthetic construct
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca

SEQ ID NO: 1354 - DNA, 8504 bp, Artificial sequence
  Synthetic construct
aggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagcttggccagcttctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattagatctggtaccctcagcagtcgctgtgcgatcgccagcggtactcgctgaggtcgacgtagttagttaattcagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgcggccgccactcgagtggaagctagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgatccccaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcgggccactcgagtggtggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcg

SEQ ID NO: 1355 - DNA, 14023 bp, Artificial sequence
  Synthetic construct
aggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagctagcttctgcaggtcctgctcgagcggccgctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccgtcgacggtaccgagctcgaattctgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaattgttctgattttgagtgcaaaaaaaaaggaattagatcgcgatcgcaagggcgaattctgcagatatccatcacactggcggccgcgcgatcgcatttaaatggcccgtagggcccctgcaggtactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagcggaccggtaccgggcccgggggatccactagttctagctatatcatcaatttatgtattacacataatatcgcactcagtctttcatctacggcaatgtaccagctgatataatcagttattgaaatatttctgaatttaaacttgcatcaataaatttatgtttttgcttggactataatacctgacttgttattttatcaataaatatttaaactatatttctttcaagatatcattctttacaagtatacgtgtttaaattgaataccataaatttttatttttcaaatacatgtaaaattatgaaatgggagtggtggcgaccgagctcaagcacacttcaattcctataacggaccaaatcgcaaaaattataataacatattatttcatcctggattaaaagaaagtcaccggggattattttgtgacgccgattacatacggcgacaataaagacattggaaatcgtagtacatattggaatacactgattatattaatgatgaatacatactttaatatccttacgtaggatcgatccgttaattaaagcttgcctcgagacaacaacatgcttctcatcaacatggagggaagagggagggagaaagtgtcgcctggtcacctccattgtcacactagccactggccagctctcccacaccaccaatgccaggggcgagctttagcacagccaccgcttcacctccaccaccgcactaccctagcttcgcccaacagccaccgtcaacgcctcctctccgtcaacataagagagagagagaagaggagagtagccatgtggggaggaggaatagtacatggggcctaccgtttggcaagttattttgggttgccaagttaggccaataaggggagggatttggccatccggttggaaaggttattggggtagtatctttttactagaattgtcaaaaaaaaatagtttgagagccatttggagaggatgttgcctgttagaggtgctcttaggacatcaaattccataaaaacatcagaaaaattctctcgatgaagatttataaccactaaaactgccctcaattcgaagggagttcaaaacaattaaaatcatgttcgaattgagtttcaatttcactttaacccctttgaaatctcaatggtaaaacatcaacccgtcaggtagcatggttctttttattcctttcaaaaagagttaattacaaacagaatcaaaactaacagttaggcccaaggcccatccgagcaaacaatagatcatgggccaggcctgccaccaccctccccctcctggctcccgctcttgaatttcaaaatccaaaaatatcggcacgactggccgccgacggagcgggcggaaaatgacggaacaacccctcgaattctaccccaactacgcccaccaacccacacgccactgacaatccggtcccacccttgtgggcccacctacaagcgagacgtcagtcgctcgcagcaaccagtgggcccacctcccagtgagcggcgggtagatctggactcttacccacccacactaaacaaaacggcatgaatattttgcactaaaaccctcagaaaaattccgatattccaaaccagtacagttcctgaccgttggaggagccaaagtggagcggagtgtaaaattgggaaacttaatcgagggggttaaacgcaaaaacgccgaggcgcctcccgctctatagaaaggggaggagtgggaggtggaaaccctaccacaccgcagagaaaggcgtcttcgtactcgcctctctccgcgccctcctccgccgccgctcgccgccgttcgtctccgccgccaccggctagccatccaggtaaaacaaacaaaaacggatctgatgcttccattcctccgtttctcgtagtagcgcgcttcgatctgtgggtggatctgggtgatcctggggtgtggttcgttctgtttgatagatctgtcggtggatctggccttctgtggttgtcgatgtccggatctgcgttttgatcagtggtagttcgtggatctggcgaaatgttttggatctggcagtgagacgctaagaatcgggaaatgatgcaatattaggggggtttcggatggggatccactgaattagtctgtctccctgctgataatctgttcctttttggtagatctggttagtgtatgtttgtttcggatagatctgatcaatgcttgtttgttttttcaaattttctacctaggttgtataggaatggcatgcggatctggttggattgccatgatccgtgctgaaatgcccctttggttgatggatcttgatattttactgctgttcacctagatttgtactcccgtttatacttaatttgttgcttattatgaatagatctgtaacttaggcacatgtatggacggagtatgtggatctgtagtatgtacattgctgcgagctaagaactatttcagagcaagcacagaaaaaaatatttagacagattgggcaactatttgatggtctttggtatcatgctttgtagtgctcgtttctgcgtagtaatcttttgatctgatctgaagataggtgctattatattcttaaaggtcattagaacgctatctgaaaggctgtattatgtggattggttcacctgtgactccctgttcgtcttgtcttgataaatcctgtgataaaaaaaattcttaaggcgtaatttgttgaaatcttgttttgtcctatgcagcctgatccatggcggcactggtgacctcccagctcgcgacaagcggcaccgtcctgtcggtgacggaccgcttccggcgtcccggcttccagggactgaggccacggaacccagccgatgccgctctcgggatgaggacggtgggcgcgtccgcggctcccaagcagagcaggaagccacaccgtttcgaccgccggtgcttgagcatggtcgtctgcatgctacacggtgcaagcagccggccggcaaccgctcgcaaatcttccggcctttcgggaacggtcaggattccgggcgataagtccatatcccaccggtcgttcatgttcggcggtcttgccagcggtgagacgcgcatcacgggcctgcttgaaggtgaggacgtgatcaataccgggaaggccatgcaggctatgggagcgcgtatccgcaaggaaggtgacacatggatcattgacggcgttgggaatggcggtctgctcgcccctgaggcccctctcgacttcggcaatgcggcgacgggctgcaggctcactatgggactggtcggggtgtacgacttcgatagcacgttcatcggagacgcctcgctcacaaagcgcccaatgggccgcgttctgaacccgttgcgcgagatgggcgtacaggtcaaatccgaggatggtgaccgtttgcccgttacgctgcgcgggccgaagacgcctaccccgattacctaccgcgtgccaatggcatccgcccaggtcaagtcagccgtgctcctcgccggactgaacactccgggcatcaccacggtgatcgagcccatcatgaccagggatcataccgaaaagatgcttcaggggtttggcgccaacctgacggtcgagacggacgctgacggcgtcaggaccatccgccttgagggcaggggtaaactgactggccaagtcatcgatgttccgggagacccgtcgtccacggccttcccgttggttgcggcgctgctcgtgccggggagtgacgtgaccatcctgaacgtcctcatgaacccgaccaggaccggcctgatcctcacgcttcaggagatgggagccgacatcgaggtgatcaacccgcgcctggcaggcggtgaagacgttgcggatctgcgcgtgcgctcctctaccctgaagggcgtgacggtcccggaagatcgcgcgccgtccatgatagacgagtatcctattctggccgtcgccgctgcgttcgccgaaggggccacggtcatgaacggtcttgaggaactccgcgtgaaggaatcggatcgcctgtcggcggtggccaatggcctgaagctcaacggtgttgactgcgacgagggtgagacctcactcgtggtccgtggccggcctgatggcaagggcctcggcaacgccagtggagcggccgtcgccacgcacctcgatcatcgcatcgcgatgtccttcttggtgatgggtctcgtctcagagaacccggtgaccgtcgatgacgccacgatgatagcgacgagcttcccagagttcatggatctgatggcgggcctcggggccaagatcgaactgtctgacacgaaggccgcttgagctccagggttcttgcctggtgccttggcaatgcttgattactgctgctatcctatgatctgtccgtgtgggcttctatctatcagtttgtgtgtctggttttgaaaaacatttgcttttcgattatgtagggtttgcttgtagctttcgctgctgtgacctgtgttgtttatgtgaaccttctttgtggcatctttaatatccaagttcgtggtttgtcgtaaaacgaagcctctacttcgtaaagttgtgtctatagcattgaaatcgtttttttgctcgagaataattgtgacctttagttggcgtgaaactagttttggatatctgattctctggttcgcaatcttgagatcgtcgctgcttaggtgagctaagtgatgttcctaagtaaatgctcctcaccagaatacgtagctgtgtgaaaagagaacgcgtgaatacgtagctgtgtaaagattgtgtcccaagtaaacctcagtgatttttgtttggatttttaatttagaaacattcgactgggagcggctagagccacacccaagttcctaactatgataaagttgctctgtaacagaaaacaccatctagggcgcgccaaatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcg

SEQ ID NO: 1356 - protein, 313 aa, Artificial
  Consensus Sequence of SEQ ID NO. 17 and homologs
  MISC_FEATURE (1)..(1): Absent or Met
  MISC_FEATURE (2)..(2): Absent or Asp or Ala
  MISC_FEATURE (3)..(3): Absent or Gly or Ser
  MISC_FEATURE (4)..(4): Absent or Gly or Thr or Ser
  MISC_FEATURE (5)..(5): Absent or Gly or Ser
  MISC_FEATURE (6)..(6): Absent or Tyr or Gly
  MISC_FEATURE (7)..(7): Absent or Asn or Ser
  MISC_FEATURE (8)..(8): Absent or Val
  MISC_FEATURE (9)..(9): Absent or Gly
  MISC_FEATURE (10)..(10): Met or Absent or Gly
  MISC_FEATURE (11)..(11): Ile or Absent or Glu
  MISC_FEATURE (12)..(12): Asn or Absent or Val
  MISC_FEATURE (13)..(13): Lys or Absent or Thr
  MISC_FEATURE (14)..(14): Ser or Absent or Gly
  MISC_FEATURE (15)..(15): Lys or Absent or Leu or Val
  MISC_FEATURE (16)..(16): Met or Absent or Thr or Pro
  MISC_FEATURE (17)..(17): Arg or Met or Absent or Thr or Gly
  MISC_FEATURE (18)..(18): Lys or Gly or Absent or Thr or Ser
  MISC_FEATURE (19)..(19): Pro or Glu or Absent or Ser
  MISC_FEATURE (20)..(20): Asn or Gly or Absent or Leu
  MISC_FEATURE (21)..(21): Ala or Absent or Ser
  MISC_FEATURE (22)..(22): Pro or Val or Met or Absent or Ser or Lys
  MISC_FEATURE (23)..(23): Glu or Val or Ala or Absent or Ser or Pro
  MISC_FEATURE (24)..(24): Leu or Val or Ala or Absent or Met or Ser
  MISC_FEATURE (25)..(25): Glu or Leu or Ala or Met
  MISC_FEATURE (26)..(26): Thr or Glu or Ala or Gln or Pro
  MISC_FEATURE (27)..(27): Ser or Pro or Ala or Val
  MISC_FEATURE (29)..(29): Leu or Lys or Arg or Cys
  MISC_FEATURE (34)..(34): His or Absent or Leu
  MISC_FEATURE (36)..(36): Ala or Arg or Absent or Gly or Glu or Asp
  MISC_FEATURE (37)..(37): Tyr or Ser or Absent or Pro or Leu
  MISC_FEATURE (40)..(40): Ile or Met or Pro or Phe or Leu
  MISC_FEATURE (41)..(41): Arg or Cys or His or Tyr
  MISC_FEATURE (43)..(43): Arg or Lys
  MISC_FEATURE (44)..(44): His or Arg
  MISC_FEATURE (46)..(46): Lys or Leu or Gln or Glu or Gly
  MISC_FEATURE (47)..(47): Gln or Met or Ala
  MISC_FEATURE (48)..(48): Val or Leu or Ala
  MISC_FEATURE (49)..(49): Glu or Ala or Lys or Arg
  MISC_FEATURE (51)..(51): Asn or Gln or Asp
  MISC_FEATURE (52)..(52): Arg or Ile or Ala or Val or Met
  MISC_FEATURE (54)..(54): Thr or Asp or His or Glu
  MISC_FEATURE (58)..(58): Ser or Thr or Gly
  MISC_FEATURE (59)..(59): Leu or Phe or Tyr
  MISC_FEATURE (62)..(62): Glu or Asp or Gly
  MISC_FEATURE (64)..(64): Leu or Ile
  MISC_FEATURE (65)..(65): Lys or His or Ser or Asn
  MISC_FEATURE (66)..(66): Thr or Leu or Ser or Phe
  MISC_FEATURE (67)..(67): Leu or Ile
  MISC_FEATURE (70)..(70): Leu or Ala or Val or Ile
  MISC_FEATURE (71)..(71): Pro or Gln or His or Asn
  MISC_FEATURE (72)..(72): Pro or Ala or His
  MISC_FEATURE (76)..(76): Absent or Ser
  MISC_FEATURE (77)..(77): Absent or Ala
  MISC_FEATURE (83)..(83): Val or Asn or Asp or Ser
  MISC_FEATURE (84)..(84): Glu or Ala or Asp
  MISC_FEATURE (86)..(86): Ile or Val
  MISC_FEATURE (87)..(87): Glu or Gly or Asp or Val
  MISC_FEATURE (88)..(88): Lys or Thr or Arg or Ser or Ala
  MISC_FEATURE (89)..(89): Arg or Lys or Asn or Thr or Val
  MISC_FEATURE (90)..(90): Pro or Gln or Ala or Ser
  MISC_FEATURE (93)..(93): Leu or Phe or Ile
  MISC_FEATURE (94)..(94): Leu or Ile or Thr
  MISC_FEATURE (95)..(95): Pro or Thr
  MISC_FEATURE (96)..(96): Phe or Ile or Thr or Ala
  MISC_FEATURE (97)..(97): Val or Asn or Gln or Ser or Arg
  MISC_FEATURE (98)..(98): Thr or Lys or Gln or Ser or Arg
  MISC_FEATURE (99)..(99): Arg or Glu or Gln or Lys
  MISC_FEATURE (100)..(100): Gly or Lys or Arg or Thr or Asn or Ser
  MISC_FEATURE (101)..(101): Gln or His or Gly or Arg or Val
  MISC_FEATURE (102)..(102): Ala or Arg or Ser or Asn or Lys
  MISC_FEATURE (103)..(103): Ile or Ser or His or Ala or Lys
  MISC_FEATURE (104)..(104): Ser or Cys or Asp
  MISC_FEATURE (105)..(105): Ser or Arg or Gln or His
  MISC_FEATURE (106)..(106): Trp or Leu or Ser or His or Phe
  MISC_FEATURE (107)..(107): Asp or Tyr or Gln or His or Phe or Trp
  MISC_FEATURE (108)..(108): Arg or Trp or Gln or His or Lys
  MISC_FEATURE (109)..(109): Trp or Phe or Arg
  MISC_FEATURE (110)..(110): Phe or Ile or Leu or Pro or Gln
  MISC_FEATURE (111)..(111): Lys or Arg or Met or Cys or Trp
  MISC_FEATURE (112)..(112): Glu or Ser or Lys or Ile or Tyr
  MISC_FEATURE (113)..(113): Arg or Lys or Phe or Ile or Ser or Cys or Absent
  MISC_FEATURE (114)..(114): Ser or Leu or Arg or Val or Absent
  MISC_FEATURE (115)..(115): Ile or Cys or Gly or Thr or Pro or Absent
  MISC_FEATURE (116)..(116): Asn or Val or Lys or Arg or Leu or Cys or Ile
  MISC_FEATURE (117)..(117): Ser or Cys or Absent or Trp or Val or Leu or Phe
  MISC_FEATURE (118)..(118): Asn or Ala or Absent or Arg or Cys or Ser
  MISC_FEATURE (119)..(119): Cys or Ser or Absent or Ala or Leu or Phe
  MISC_FEATURE (120)..(120): Ser or Trp or Absent or Ala or Pro
  MISC_FEATURE (121)..(121): Cys or Leu or Ser or Ala or Asn or Phe
  MISC_FEATURE (122)..(122): Cys or Ser or Phe
  MISC_FEATURE (124)..(124): Ser or Leu or Cys or Met
  MISC_FEATURE (125)..(125): Cys or Tyr or Ser or Leu or Phe
  MISC_FEATURE (126)..(126): Lys or Gln or Tyr or Phe or His or Cys
  MISC_FEATURE (127)..(127): His or Cys or Leu or Pro or Lys or Gln or Ile
  MISC_FEATURE (128)..(128): Val or Leu or Ser or Absent or Lys or Tyr
  MISC_FEATURE (129)..(129): Lys or Pro or Trp or Thr or Glu
  MISC_FEATURE (130)..(130): Ile or Thr or Ala or Cys
  MISC_FEATURE (131)..(131): Trp or Cys or Lys or Ser or Met
  MISC_FEATURE (132)..(132): Lys or Gly or Cys or Absent
  MISC_FEATURE (133)..(133): Phe or Arg or Absent or Cys
  MISC_FEATURE (134)..(134): Ser or Pro or Absent
  MISC_FEATURE (135)..(135): Absent or Ser
  MISC_FEATURE (136)..(136): Absent or Cys or Ala
  MISC_FEATURE (137)..(137): Absent or Leu or Ala
  MISC_FEATURE (138)..(138): Absent or Asp or Gly
  MISC_FEATURE (139)..(139): Absent or Cys or Gly
  MISC_FEATURE (140)..(140): Absent or Ser or Trp or Cys
  MISC_FEATURE (141)..(141): Absent or Cys or Trp or Ser
  MISC_FEATURE (142)..(142): Absent or Cys or Ser
  MISC_FEATURE (143)..(143): Absent or Glu or Pro or Ser
  MISC_FEATURE (144)..(144): Absent or Pro or Ser
  MISC_FEATURE (145)..(145): Absent or Asn or Pro or Ala or Ser
  MISC_FEATURE (146)..(146): Absent or Cys or Leu or Val or Ser
  MISC_FEATURE (147)..(147): Absent or Ser or Gln
  MISC_FEATURE (148)..(148): Absent or Cys or Leu or Phe
  MISC_FEATURE (149)..(149): Absent or Cys or Lys or Asn
  MISC_FEATURE (150)..(150): Absent or Ser or Arg
  MISC_FEATURE (151)..(151): Absent or Pro or Leu
  MISC_FEATURE (152)..(152): Absent or Asn or Pro or Lys
  MISC_FEATURE (153)..(153): Absent or Cys or Ala or Gly or Arg
  MISC_FEATURE (154)..(154): Absent or Cys or Pro
  MISC_FEATURE (155)..(155): Absent or Ser
  MISC_FEATURE (156)..(156): Absent or Cys
  MISC_FEATURE (157)..(157): Absent or Phe or Ser or Cys
  MISC_FEATURE (158)..(158): Absent or Lys or Cys
  MISC_FEATURE (159)..(159): Absent or Ile or Ala or Gly or Asn
  MISC_FEATURE (160)..(160): Absent or Pro or Cys
  MISC_FEATURE (161)..(161): Absent or Ser or Arg or Asn
  MISC_FEATURE (162)..(162): Absent or Cys or Leu
  MISC_FEATURE (163)..(163): Absent or Cys or Gly or Asn
  MISC_FEATURE (164)..(164): Absent or Lys or Cys
  MISC_FEATURE (165)..(165): Absent or Pro or Leu or Cys
  MISC_FEATURE (166)..(166): Absent or Ser or Cys
  MISC_FEATURE (167)..(167): Absent or Cys or Ser
  MISC_FEATURE (168)..(168): Absent or Gly or Ser
  MISC_FEATURE (169)..(169): Absent or Cys or Thr or Ser
  MISC_FEATURE (170)..(170): Absent or Phe or Ala or Ser
  MISC_FEATURE (171)..(171): Absent or Gly or Ser
  MISC_FEATURE (172)..(172): Absent or Cys or Ser
  MISC_FEATURE (173)..(173): Absent or Cys or Gly
  MISC_FEATURE (174)..(174): Absent or Ser or Ala
  MISC_FEATURE (175)..(175): Absent or Cys or Ala
  MISC_FEATURE (176)..(176): Absent or Ser or Leu
  MISC_FEATURE (177)..(177): Absent or Lys or Thr
  MISC_FEATURE (178)..(178): Absent or Pro or Lys
  MISC_FEATURE (179)..(179): Absent or Gln or Ser
  MISC_FEATURE (180)..(180): Absent or Cys or Pro
  MISC_FEATURE (181)..(181): Absent or Cys
  MISC_FEATURE (182)..(182): Absent or Ser or Arg
  MISC_FEATURE (183)..(183): Absent or Gly or Cys
  MISC_FEATURE (184)..(184): Absent or Gly or Arg
  MISC_FEATURE (185)..(185): Absent or Cys or Arg
  MISC_FEATURE (186)..(186): Absent or Asn or Arg
  MISC_FEATURE (187)..(187): Absent or Pro or Ser
  MISC_FEATURE (188)..(188): Absent or Cys
  MISC_FEATURE (189)..(189): Absent or Gly
  MISC_FEATURE (190)..(190): Absent or Glu
  MISC_FEATURE (191)..(191): Absent or Cys
  MISC_FEATURE (192)..(192): Absent or Lys
  MISC_FEATURE (193)..(193): Absent or Pro
  MISC_FEATURE (194)..(194): Absent or Glu
  MISC_FEATURE (195)..(195): Absent or Cys
  MISC_FEATURE (196)..(196): Absent or Gly
  MISC_FEATURE (197)..(197): Absent or Ser
  MISC_FEATURE (198)..(198): Absent or Cys
  MISC_FEATURE (199)..(199): Absent or Ser
  MISC_FEATURE (200)..(200): Absent or Ala
  MISC_FEATURE (201)..(201): Absent or Gly
  MISC_FEATURE (202)..(202): Absent or Gly
  MISC_FEATURE (203)..(203): Tyr or Cys or Absent
  MISC_FEATURE (204)..(204): Trp or Cys or Absent
  MISC_FEATURE (205)..(205): Lys or Gly or Ser or Pro or Arg or Asp or Absent
  MISC_FEATURE (206)..(206): Arg or Asp or Cys or Absent
  MISC_FEATURE (208)..(208): Ile or Lys or Cys or Ser or His
  MISC_FEATURE (209)..(209): Cys or Pro or Val or Ser or Leu
  MISC_FEATURE (210)..(210): Trp or Ser or Arg or Gly
  MISC_FEATURE (211)..(211): Lys or Cys or Absent or Gly or Asn or Tyr
  MISC_FEATURE (212)..(212): Leu or Ser or Absent or Val
  MISC_FEATURE (213)..(213): Thr or Cys or Absent or Gly
  MISC_FEATURE (214)..(214): Phe or Cys or Absent or Val
  MISC_FEATURE (215)..(215): Arg or Gly or Absent
  MISC_FEATURE (216)..(216): Absent or Glu or Ala
  MISC_FEATURE (217)..(217): Absent or Gln or Phe or Ser or Cys
  MISC_FEATURE (218)..(218): Lys or Cys or Arg or Gly or Ala or Ser or Pro or Leu
  MISC_FEATURE (219)..(219): Ala or Gln or Val or Gly or Ser or Lys or Ile
  MISC_FEATURE (221)..(221): Cys or Tyr or Gly or Ser or Ile
  MISC_FEATURE (222)..(222): Val or Ser or Ala or Gly or Cys or His or Asn
  MISC_FEATURE (223)..(223): Phe or Cys or Ala or Gly or Ser
  MISC_FEATURE (224)..(224): Pro or Ala or Cys or Thr or Val
  MISC_FEATURE (225)..(225): Arg or Gly or Ser or Pro or Leu
  MISC_FEATURE (227)..(227): Ser or Thr or Gly or Ala or Cys or Val
  MISC_FEATURE (229)..(229): His or Gly or Cys or Ser or Ile or Asn
  MISC_FEATURE (230)..(230): Lys or Cys or Ala or Gly or Phe
  MISC_FEATURE (231)..(231): Cys or Phe or Pro or Ser or Leu
  MISC_FEATURE (232)..(232): Cys or Lys or Absent or Pro or Gln or Thr
  MISC_FEATURE (233)..(233): Cys or Leu or Ser
  MISC_FEATURE (234)..(234): Phe or Pro or Ala or Cys or Ile
  MISC_FEATURE (235)..(235): Gln or Lys or Arg or Gly or Ser or Asp
  MISC_FEATURE (236)..(236): Cys or Arg or Gly
  MISC_FEATURE (238)..(238): Cys or Ser or Absent or Leu
  MISC_FEATURE (239)..(239): Ala or Asp or Absent or Arg or Ser
  MISC_FEATURE (240)..(240): Gly or Gln or Cys or Absent or Thr
  MISC_FEATURE (241)..(241): Cys or Thr or Ser or Lys or Ile
  MISC_FEATURE (242)..(242): Ile or Phe or Cys or Leu or Ser
  MISC_FEATURE (243)..(243): Lys or Asn or Ala or Pro or Leu
  MISC_FEATURE (244)..(244): Cys or Leu or Ile
  MISC_FEATURE (245)..(245): Cys or Gln or Pro or Glu or Val
  MISC_FEATURE (246)..(246): Pro or Ser or Arg or Ala or Cys or Val
  MISC_FEATURE (247)..(247): Leu or Ser or Cys or Pro or Ala or Asn
  MISC_FEATURE (248)..(248): Cys or Ala or Gly or Phe or Pro
  MISC_FEATURE (249)..(249): Lys or Cys or Ser or Gly or Asn
  MISC_FEATURE (250)..(250): Asn or Lys or Cys or Pro or Ala
  MISC_FEATURE (251)..(251): Lys or Gly or Ala or Ser or Glu
  MISC_FEATURE (252)..(252): Absent or Gln or Cys or Ala or Pro or Leu
  MISC_FEATURE (253)..(253): Absent or Pro or Ala or Ser
  MISC_FEATURE (254)..(254): Absent or Ser or Met or Cys or Gly or Phe or Ile
  MISC_FEATURE (255)..(255): Absent or Cys or Pro or Ser
  MISC_FEATURE (256)..(256): Absent or Phe or Gly or Leu
  MISC_FEATURE (257)..(257): Absent or Arg or Gly or Ala or Cys
  MISC_FEATURE (258)..(258): Absent or Cys or Gly or Glu
  MISC_FEATURE (259)..(259): Absent or Gln or Arg or Glu
  MISC_FEATURE (260)..(260): Absent or Ser or Gly or X or Cys or Leu
  MISC_FEATURE (261)..(261): Absent or Ser or Ala or Gly or Cys or Leu
  MISC_FEATURE (262)..(262): Absent or Cys or Ala or Ser
  MISC_FEATURE (263)..(263): Absent or Cys or Pro or Gly or Tyr
  MISC_FEATURE (264)..(264): Absent or Asp or Cys or Arg or Thr
  MISC_FEATURE (265)..(265): Absent or Lys or Ala or Arg or Pro or Val
  MISC_FEATURE (266)..(266): Absent or Gly or Pro or Tyr
  MISC_FEATURE (267)..(267): Absent or Gly or Arg or Leu or Gln
  MISC_FEATURE (268)..(268): Absent or Cys
  MISC_FEATURE (269)..(269): Absent or Cys or Trp
  MISC_FEATURE (270)..(270): Absent or Ser or Leu or Pro
  MISC_FEATURE (271)..(271): Absent or Ser or Cys or Pro
  MISC_FEATURE (272)..(272): Absent or Gly or Leu or Ser or Pro
  MISC_FEATURE (273)..(273): Absent or Ser or Gly
  MISC_FEATURE (274)..(274): Absent or Cys or Phe
  MISC_FEATURE (275)..(275): Absent or Leu or Gly
  MISC_FEATURE (276)..(276): Absent or Ser or Asp
  MISC_FEATURE (277)..(277): Absent or Cys or Pro
  MISC_FEATURE (278)..(278): Absent or Pro or Asn
  MISC_FEATURE (279)..(279): Absent or Lys or Gln
  MISC_FEATURE (280)..(280): Absent or Pro
  MISC_FEATURE (281)..(281): Absent or Ser or Asn
  MISC_FEATURE (282)..(282): Absent or Cys or Trp
  MISC_FEATURE (283)..(283): Absent or Pro or Thr
  MISC_FEATURE (284)..(284): Absent or Glu or Gln
  MISC_FEATURE (285)..(285): Absent or Cys or Thr
  MISC_FEATURE (286)..(286): Absent or Ser or Cys
  MISC_FEATURE (287)..(287): Absent or Cys or Pro or Leu
  MISC_FEATURE (288)..(288): Absent or Gly or Arg
  MISC_FEATURE (289)..(289): Absent or Cys or Ile
  MISC_FEATURE (290)..(290): Absent or Val or Trp
  MISC_FEATURE (291)..(291): Absent or Trp or Val
  MISC_FEATURE (292)..(292): Absent or Ser or Lys
  MISC_FEATURE (293)..(293): Absent or Cys or Leu
  MISC_FEATURE (294)..(294): Absent or Lys or Asn
  MISC_FEATURE (295)..(295): Absent or Asn or Leu
  MISC_FEATURE (296)..(296): Absent or Cys or Val
  MISC_FEATURE (297)..(297): Absent or Thr or Pro
  MISC_FEATURE (298)..(298): Absent or Asp or Arg
  MISC_FEATURE (299)..(299): Absent or Gly or Lys
  MISC_FEATURE (300)..(300): Absent or Cys or Glu
  MISC_FEATURE (301)..(301): Absent or Arg or Glu
  MISC_FEATURE (302)..(302): Absent or Cys or Thr
  MISC_FEATURE (303)..(303): Absent or Ala or Glu
  MISC_FEATURE (304)..(304): Absent or Arg or Ser
  MISC_FEATURE (305)..(305): Absent or Cys or Gly
  MISC_FEATURE (306)..(306): Absent or Cys or Pro
  MISC_FEATURE (307)..(307): Absent or Ala
  MISC_FEATURE (308)..(308): Absent or Ser or Ala
  MISC_FEATURE (309)..(309): Absent or Gly or Pro
  MISC_FEATURE (310)..(310): Absent or Cys or Ala
  MISC_FEATURE (311)..(311): Absent or Leu or Ile
  MISC_FEATURE (312)..(312): Absent or Cys or Leu
  MISC_FEATURE (313)..(313): Absent or Lys
XXXXXXXXXXXXXXXXXXXXXXXXXXXPXPKSPXPXXPDXXGXXRXXXXVXXLXREIXXLEXEXXXXEGXXXASRXXCCKEVXXFXXXXXDPXXXXXXXXXXXXXXXXXXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXCXXXXXXXXXXXXCXXXXXCXCXXXXXXXXSXXXXXXXXXXXXXXXXXXXXXXXXXXXXXXXXXXXXXXXXXXXXXXXXXXXXXXXXXXXXXXXXXXXXXXXXXXXX

SEQ ID NO: 1357 - protein, 313 aa, Artificial; identical to SEQ ID NO: 1356
  Consensus Sequence of SEQ ID NO. 18 and Homologs
  MISC_FEATURE (1)..(1): Absent or Met
  MISC_FEATURE (2)..(2): Absent or Asp or Ala
  MISC_FEATURE (3)..(3): Absent or Gly or Ser
  MISC_FEATURE (4)..(4): Absent or Gly or Thr or Ser
  MISC_FEATURE (5)..(5): Absent or Gly or Ser
  MISC_FEATURE (6)..(6): Absent or Tyr or Gly
  MISC_FEATURE (7)..(7): Absent or Asn or Ser
  MISC_FEATURE (8)..(8): Absent or Val
  MISC_FEATURE (9)..(9): Absent or Gly
  MISC_FEATURE (10)..(10): Met or Absent or Gly
  MISC_FEATURE (11)..(11): Ile or Absent or Glu
  MISC_FEATURE (12)..(12): Asn or Absent or Val
  MISC_FEATURE (13)..(13): Lys or Absent or Thr
  MISC_FEATURE (14)..(14): Ser or Absent or Gly
  MISC_FEATURE (15)..(15): Lys or Absent or Leu or Val
  MISC_FEATURE (16)..(16): Met or Absent or Thr or Pro
  MISC_FEATURE (17)..(17): Arg or Met or Absent or Thr or Gly
  MISC_FEATURE (18)..(18): Lys or Gly or Absent or Thr or Ser
  MISC_FEATURE (19)..(19): Pro or Glu or Absent or Ser
  MISC_FEATURE (20)..(20): Asn or Gly or Absent or Leu
  MISC_FEATURE (21)..(21): Ala or Absent or Ser
  MISC_FEATURE (22)..(22): Pro or Val or Met or Absent or Ser or Lys
  MISC_FEATURE (23)..(23): Glu or Val or Ala or Absent or Ser or Pro
  MISC_FEATURE (24)..(24): Leu or Val or Ala or Absent or Met or Ser
  MISC_FEATURE (25)..(25): Glu or Leu or Ala or Met
  MISC_FEATURE (26)..(26): Thr or Glu or Ala or Gln or Pro
  MISC_FEATURE (27)..(27): Ser or Pro or Ala or Val
  MISC_FEATURE (29)..(29): Leu or Lys or Arg or Cys
  MISC_FEATURE (34)..(34): His or Absent or Leu
  MISC_FEATURE (36)..(36): Ala or Arg or Absent or Gly or Glu or Asp
  MISC_FEATURE (37)..(37): Tyr or Ser or Absent or Pro or Leu
  MISC_FEATURE (40)..(40): Ile or Met or Pro or Phe or Leu
  MISC_FEATURE (41)..(41): Arg or Cys or His or Tyr
  MISC_FEATURE (43)..(43): Arg or Lys
  MISC_FEATURE (44)..(44): His or Arg
  MISC_FEATURE (46)..(46): Lys or Leu or Gln or Glu or Gly
  MISC_FEATURE (47)..(47): Gln or Met or Ala
  MISC_FEATURE (48)..(48): Val or Leu or Ala
  MISC_FEATURE (49)..(49): Glu or Ala or Lys or Arg
  MISC_FEATURE (51)..(51): Asn or Gln or Asp
  MISC_FEATURE (52)..(52): Arg or Ile or Ala or Val or Met
  MISC_FEATURE (54)..(54): Thr or Asp or His or Glu
  MISC_FEATURE (58)..(58): Ser or Thr or Gly
  MISC_FEATURE (59)..(59): Leu or Phe or Tyr
  MISC_FEATURE (62)..(62): Glu or Asp or Gly
  MISC_FEATURE (64)..(64): Leu or Ile
  MISC_FEATURE (65)..(65): Lys or His or Ser or Asn
  MISC_FEATURE (66)..(66): Thr or Leu or Ser or Phe
  MISC_FEATURE (67)..(67): Leu or Ile
  MISC_FEATURE (70)..(70): Leu or Ala or Val or Ile
  MISC_FEATURE (71)..(71): Pro or Gln or His or Asn
  MISC_FEATURE (72)..(72): Pro or Ala or His
  MISC_FEATURE (76)..(76): Absent or Ser
  MISC_FEATURE (77)..(77): Absent or Ala
  MISC_FEATURE (83)..(83): Val or Asn or Asp or Ser
  MISC_FEATURE (84)..(84): Glu or Ala or Asp
  MISC_FEATURE (86)..(86): Ile or Val
  MISC_FEATURE (87)..(87): Glu or Gly or Asp or Val
  MISC_FEATURE (88)..(88): Lys or Thr or Arg or Ser or Ala
  MISC_FEATURE (89)..(89): Arg or Lys or Asn or Thr or Val
  MISC_FEATURE (90)..(90): Pro or Gln or Ala or Ser
  MISC_FEATURE (93)..(93): Leu or Phe or Ile
  MISC_FEATURE (94)..(94): Leu or Ile or Thr
  MISC_FEATURE (95)..(95): Pro or Thr
  MISC_FEATURE (96)..(96): Phe or Ile or Thr or Ala
  MISC_FEATURE (97)..(97): Val or Asn or Gln or Ser or Arg
  MISC_FEATURE (98)..(98): Thr or Lys or Gln or Ser or Arg
  MISC_FEATURE (99)..(99): Arg or Glu or Gln or Lys
  MISC_FEATURE (100)..(100): Gly or Lys or Arg or Thr or Asn or Ser
  MISC_FEATURE (101)..(101): Gln or His or Gly or Arg or Val
  MISC_FEATURE (102)..(102): Ala or Arg or Ser or Asn or Lys
  MISC_FEATURE (103)..(103): Ile or Ser or His or Ala or Lys
  MISC_FEATURE (104)..(104): Ser or Cys or Asp
  MISC_FEATURE (105)..(105): Ser or Arg or Gln or His
  MISC_FEATURE (106)..(106): Trp or Leu or Ser or His or Phe
  MISC_FEATURE (107)..(107): Asp or Tyr or Gln or His or Phe or Trp
  MISC_FEATURE (108)..(108): Arg or Trp or Gln or His or Lys
  MISC_FEATURE (109)..(109): Trp or Phe or Arg
  MISC_FEATURE (110)..(110): Phe or Ile or Leu or Pro or Gln
  MISC_FEATURE (111)..(111): Lys or Arg or Met or Cys or Trp
  MISC_FEATURE (112)..(112): Glu or Ser or Lys or Ile or Tyr
  MISC_FEATURE (113)..(113): Arg or Lys or Phe or Ile or Ser or Cys or Absent
  MISC_FEATURE (114)..(114): Ser or Leu or Arg or Val or Absent
  MISC_FEATURE (115)..(115): Ile or Cys or Gly or Thr or Pro or Absent
  MISC_FEATURE (116)..(116): Asn or Val or Lys or Arg or Leu or Cys or Ile
  MISC_FEATURE (117)..(117): Ser or Cys or Absent or Trp or Val or Leu or Phe
  MISC_FEATURE (118)..(118): Asn or Ala or Absent or Arg or Cys or Ser
  MISC_FEATURE (119)..(119): Cys or Ser or Absent or Ala or Leu or Phe
  MISC_FEATURE (120)..(120): Ser or Trp or Absent or Ala or Pro
  MISC_FEATURE (121)..(121): Cys or Leu or Ser or Ala or Asn or Phe
  MISC_FEATURE (122)..(122): Cys or Ser or Phe
  MISC_FEATURE (124)..(124): Ser or Leu or Cys or Met
  MISC_FEATURE (125)..(125): Cys or Tyr or Ser or Leu or Phe
  MISC_FEATURE (126)..(126): Lys or Gln or Tyr or Phe or His or Cys
  MISC_FEATURE (127)..(127): His or Cys or Leu or Pro or Lys or Gln or Ile
  MISC_FEATURE (128)..(128): Val or Leu or Ser or Absent or Lys or Tyr
  MISC_FEATURE (129)..(129): Lys or Pro or Trp or Thr or Glu
  MISC_FEATURE (130)..(130): Ile or Thr or Ala or Cys
  MISC_FEATURE (131)..(131): Trp or Cys or Lys or Ser or Met
  MISC_FEATURE (132)..(132): Lys or Gly or Cys or Absent
  MISC_FEATURE (133)..(133): Phe or Arg or Absent or Cys
  MISC_FEATURE (134)..(134): Ser or Pro or Absent
  MISC_FEATURE (135)..(135): Absent or Ser
  MISC_FEATURE (136)..(136): Absent or Cys or Ala
  MISC_FEATURE (137)..(137): Absent or Leu or Ala
  MISC_FEATURE (138)..(138): Absent or Asp or Gly
  MISC_FEATURE (139)..(139): Absent or Cys or Gly
  MISC_FEATURE (140)..(140): Absent or Ser or Trp or Cys
  MISC_FEATURE (141)..(141): Absent or Cys or Trp or Ser
  MISC_FEATURE (142)..(142): Absent or Cys or Ser
  MISC_FEATURE (143)..(143): Absent or Glu or Pro or Ser
  MISC_FEATURE (144)..(144): Absent or Pro or Ser
  MISC_FEATURE (145)..(145): Absent or Asn or Pro or Ala or Ser
  MISC_FEATURE (146)..(146): Absent or Cys or Leu or Val or Ser
  MISC_FEATURE (147)..(147): Absent or Ser or Gln
  MISC_FEATURE (148)..(148): Absent or Cys or Leu or Phe
  MISC_FEATURE (149)..(149): Absent or Cys or Lys or Asn
  MISC_FEATURE (150)..(150): Absent or Ser or Arg
  MISC_FEATURE (151)..(151): Absent or Pro or Leu
  MISC_FEATURE (152)..(152): Absent or Asn or Pro or Lys
  MISC_FEATURE (153)..(153): Absent or Cys or Ala or Gly or Arg
  MISC_FEATURE (154)..(154): Absent or Cys or Pro
  MISC_FEATURE (155)..(155): Absent or Ser
  MISC_FEATURE (156)..(156): Absent or Cys
  MISC_FEATURE (157)..(157): Absent or Phe or Ser or Cys
  MISC_FEATURE (158)..(158): Absent or Lys or Cys
  MISC_FEATURE (159)..(159): Absent or Ile or Ala or Gly or Asn
  MISC_FEATURE (160)..(160): Absent or Pro or Cys
  MISC_FEATURE (161)..(161): Absent or Ser or Arg or Asn
  MISC_FEATURE (162)..(162): Absent or Cys or Leu
  MISC_FEATURE (163)..(163): Absent or Cys or Gly or Asn
  MISC_FEATURE (164)..(164): Absent or Lys or Cys
  MISC_FEATURE (165)..(165): Absent or Pro or Leu or Cys
  MISC_FEATURE (166)..(166): Absent or Ser or Cys
  MISC_FEATURE (167)..(167): Absent or Cys or Ser
  MISC_FEATURE (168)..(168): Absent or Gly or Ser
  MISC_FEATURE (169)..(169): Absent or Cys or Thr or Ser
  MISC_FEATURE (170)..(170): Absent or Phe or Ala or Ser
  MISC_FEATURE (171)..(171): Absent or Gly or Ser
  MISC_FEATURE (172)..(172): Absent or Cys or Ser
  MISC_FEATURE (173)..(173): Absent or Cys or Gly
  MISC_FEATURE (174)..(174): Absent or Ser or Ala
  MISC_FEATURE (175)..(175): Absent or Cys or Ala
  MISC_FEATURE (176)..(176): Absent or Ser or Leu
  MISC_FEATURE (177)..(177): Absent or Lys or Thr
  MISC_FEATURE (178)..(178): Absent or Pro or Lys
  MISC_FEATURE (179)..(179): Absent or Gln or Ser
  MISC_FEATURE (180)..(180): Absent or Cys or Pro
  MISC_FEATURE (181)..(181): Absent or Cys
  MISC_FEATURE (182)..(182): Absent or Ser or Arg
  MISC_FEATURE (183)..(183): Absent or Gly or Cys
  MISC_FEATURE (184)..(184): Absent or Gly or Arg
  MISC_FEATURE (185)..(185): Absent or Cys or Arg
  MISC_FEATURE (186)..(186): Absent or Asn or Arg
  MISC_FEATURE (187)..(187): Absent or Pro or Ser
  MISC_FEATURE (188)..(188): Absent or Cys
  MISC_FEATURE (189)..(189): Absent or Gly
  MISC_FEATURE (190)..(190): Absent or Glu
  MISC_FEATURE (191)..(191): Absent or Cys
  MISC_FEATURE (192)..(192): Absent or Lys
  MISC_FEATURE (193)..(193): Absent or Pro
  MISC_FEATURE (194)..(194): Absent or Glu
  MISC_FEATURE (195)..(195): Absent or Cys
  MISC_FEATURE (196)..(196): Absent or Gly
  MISC_FEATURE (197)..(197): Absent or Ser
  MISC_FEATURE (198)..(198): Absent or Cys
  MISC_FEATURE (199)..(199): Absent or Ser
  MISC_FEATURE (200)..(200): Absent or Ala
  MISC_FEATURE (201)..(201): Absent or Gly
  MISC_FEATURE (202)..(202): Absent or Gly
  MISC_FEATURE (203)..(203): Tyr or Cys or Absent
  MISC_FEATURE (204)..(204): Trp or Cys or Absent
  MISC_FEATURE (205)..(205): Lys or Gly or Ser or Pro or Arg or Asp or Absent
  MISC_FEATURE (206)..(206): Arg or Asp or Cys or Absent
  MISC_FEATURE (208)..(208): Ile or Lys or Cys or Ser or His
  MISC_FEATURE (209)..(209): Cys or Pro or Val or Ser or Leu
  MISC_FEATURE (210)..(210): Trp or Ser or Arg or Gly
  MISC_FEATURE (211)..(211): Lys or Cys or Absent or Gly or Asn or Tyr
  MISC_FEATURE (212)..(212): Leu or Ser or Absent or Val
  MISC_FEATURE (213)..(213): Thr or Cys or Absent or Gly
  MISC_FEATURE (214)..(214): Phe or Cys or Absent or Val
  MISC_FEATURE (215)..(215): Arg or Gly or Absent
  MISC_FEATURE (216)..(216): Absent or Glu or Ala
  MISC_FEATURE (217)..(217): Absent or Gln or Phe or Ser or Cys
  MISC_FEATURE (218)..(218): Lys or Cys or Arg or Gly or Ala or Ser or Pro or Leu
  MISC_FEATURE (219)..(219): Ala or Gln or Val or Gly or Ser or Lys or Ile
  MISC_FEATURE (221)..(221): Cys or Tyr or Gly or Ser or Ile
  MISC_FEATURE (222)..(222): Val or Ser or Ala or Gly or Cys or His or Asn
  MISC_FEATURE (223)..(223): Phe or Cys or Ala or Gly or Ser
  MISC_FEATURE (224)..(224): Pro or Ala or Cys or Thr or Val
  MISC_FEATURE (225)..(225): Arg or Gly or Ser or Pro or Leu
  MISC_FEATURE (227)..(227): Ser or Thr or Gly or Ala or Cys or Val
  MISC_FEATURE (229)..(229): His or Gly or Cys or Ser or Ile or Asn
  MISC_FEATURE (230)..(230): Lys or Cys or Ala or Gly or Phe
  MISC_FEATURE (231)..(231): Cys or Phe or Pro or Ser or Leu
  MISC_FEATURE (232)..(232): Cys or Lys or Absent or Pro or Gln or Thr
  MISC_FEATURE (233)..(233): Cys or Leu or Ser
  MISC_FEATURE (234)..(234): Phe or Pro or Ala or Cys or Ile
  MISC_FEATURE (235)..(235): Gln or Lys or Arg or Gly or Ser or Asp
  MISC_FEATURE (236)..(236): Cys or Arg or Gly
  MISC_FEATURE (238)..(238): Cys or Ser or Absent or Leu
  MISC_FEATURE (239)..(239): Ala or Asp or Absent or Arg or Ser
  MISC_FEATURE (240)..(240): Gly or Gln or Cys or Absent or Thr
  MISC_FEATURE (241)..(241): Cys or Thr or Ser or Lys or Ile
  MISC_FEATURE (242)..(242): Ile or Phe or Cys or Leu or Ser
  MISC_FEATURE (243)..(243): Lys or Asn or Ala or Pro or Leu
  MISC_FEATURE (244)..(244): Cys or Leu or Ile
  MISC_FEATURE (245)..(245): Cys or Gln or Pro or Glu or Val
  MISC_FEATURE (246)..(246): Pro or Ser or Arg or Ala or Cys or Val
  MISC_FEATURE (247)..(247): Leu or Ser or Cys or Pro or Ala or Asn
  MISC_FEATURE (248)..(248): Cys or Ala or Gly or Phe or Pro
  MISC_FEATURE (249)..(249): Lys or Cys or Ser or Gly or Asn
  MISC_FEATURE (250)..(250): Asn or Lys or Cys or Pro or Ala
  MISC_FEATURE (251)..(251): Lys or Gly or Ala or Ser or Glu
  MISC_FEATURE (252)..(252): Absent or Gln or Cys or Ala or Pro or Leu
  MISC_FEATURE (253)..(253): Absent or Pro or Ala or Ser
  MISC_FEATURE (254)..(254): Absent or Ser or Met or Cys or Gly or Phe or Ile
  MISC_FEATURE (255)..(255): Absent or Cys or Pro or Ser
  MISC_FEATURE (256)..(256): Absent or Phe or Gly or Leu
  MISC_FEATURE (257)..(257): Absent or Arg or Gly or Ala or Cys
  MISC_FEATURE (258)..(258): Absent or Cys or Gly or Glu
  MISC_FEATURE (259)..(259): Absent or Gln or Arg or Glu
  MISC_FEATURE (260)..(260): Absent or Ser or Gly or X or Cys or Leu
  MISC_FEATURE (261)..(261): Absent or Ser or Ala or Gly or Cys or Leu
  MISC_FEATURE (262)..(262): Absent or Cys or Ala or Ser
  MISC_FEATURE (263)..(263): Absent or Cys or Pro or Gly or Tyr
  MISC_FEATURE (264)..(264): Absent or Asp or Cys or Arg or Thr
  MISC_FEATURE (265)..(265): Absent or Lys or Ala or Arg or Pro or Val
  MISC_FEATURE (266)..(266): Absent or Gly or Pro or Tyr
  MISC_FEATURE (267)..(267): Absent or Gly or Arg or Leu or Gln
  MISC_FEATURE (268)..(268): Absent or Cys
  MISC_FEATURE (269)..(269): Absent or Cys or Trp
  MISC_FEATURE (270)..(270): Absent or Ser or Leu or Pro
  MISC_FEATURE (271)..(271): Absent or Ser or Cys or Pro
  MISC_FEATURE (272)..(272): Absent or Gly or Leu or Ser or Pro
  MISC_FEATURE (273)..(273): Absent or Ser or Gly
  MISC_FEATURE (274)..(274): Absent or Cys or Phe
  MISC_FEATURE (275)..(275): Absent or Leu or Gly
  MISC_FEATURE (276)..(276): Absent or Ser or Asp
  MISC_FEATURE (277)..(277): Absent or Cys or Pro
  MISC_FEATURE (278)..(278): Absent or Pro or Asn
  MISC_FEATURE (279)..(279): Absent or Lys or Gln
  MISC_FEATURE (280)..(280): Absent or Pro
  MISC_FEATURE (281)..(281): Absent or Ser or Asn
  MISC_FEATURE (282)..(282): Absent or Cys or Trp
  MISC_FEATURE (283)..(283): Absent or Pro or Thr
  MISC_FEATURE (284)..(284): Absent or Glu or Gln
  MISC_FEATURE (285)..(285): Absent or Cys or Thr
  MISC_FEATURE (286)..(286): Absent or Ser or Cys
  MISC_FEATURE (287)..(287): Absent or Cys or Pro or Leu
  MISC_FEATURE (288)..(288): Absent or Gly or Arg
  MISC_FEATURE (289)..(289): Absent or Cys or Ile
  MISC_FEATURE (290)..(290): Absent or Val or Trp
  MISC_FEATURE (291)..(291): Absent or Trp or Val
  MISC_FEATURE (292)..(292): Absent or Ser or Lys
  MISC_FEATURE (293)..(293): Absent or Cys or Leu
  MISC_FEATURE (294)..(294): Absent or Lys or Asn
  MISC_FEATURE (295)..(295): Absent or Asn or Leu
  MISC_FEATURE (296)..(296): Absent or Cys or Val
  MISC_FEATURE (297)..(297): Absent or Thr or Pro
  MISC_FEATURE (298)..(298): Absent or Asp or Arg
  MISC_FEATURE (299)..(299): Absent or Gly or Lys
  MISC_FEATURE (300)..(300): Absent or Cys or Glu
  MISC_FEATURE (301)..(301): Absent or Arg or Glu
  MISC_FEATURE (302)..(302): Absent or Cys or Thr
  MISC_FEATURE (303)..(303): Absent or Ala or Glu
  MISC_FEATURE (304)..(304): Absent or Arg or Ser
  MISC_FEATURE (305)..(305): Absent or Cys or Gly
  MISC_FEATURE (306)..(306): Absent or Cys or Pro
  MISC_FEATURE (307)..(307): Absent or Ala
  MISC_FEATURE (308)..(308): Absent or Ser or Ala
  MISC_FEATURE (309)..(309): Absent or Gly or Pro
  MISC_FEATURE (310)..(310): Absent or Cys or Ala
  MISC_FEATURE (311)..(311): Absent or Leu or Ile
  MISC_FEATURE (312)..(312): Absent or Cys or Leu
  MISC_FEATURE (313)..(313): Absent or Lys

SEQ ID NO: 1358 - protein, 253 aa, Artificial
  Consensus Sequence of SEQ ID 19 and Homologs
  MISC_FEATURE (1)..(1): Absent or Arg
  MISC_FEATURE (2)..(2): Absent or Asp
  MISC_FEATURE (3)..(3): Absent or Arg
  MISC_FEATURE (4)..(4): Absent or Ser
  MISC_FEATURE (5)..(5): Absent or Thr or Met
  MISC_FEATURE (6)..(6): Absent or Ser or Thr
  MISC_FEATURE (115)..(115): Ser or Asp or Gly
  MISC_FEATURE (131)..(131): Absent or Leu or Ile
  MISC_FEATURE (132)..(132): Absent or Asp or Gln
  MISC_FEATURE (133)..(133): Absent or Gln
  MISC_FEATURE (134)..(134): Absent or Val
  MISC_FEATURE (135)..(135): Absent or His
  MISC_FEATURE (136)..(136): Absent or Gln
  MISC_FEATURE (137)..(137): Absent or Ser
  MISC_FEATURE (138)..(138): Absent or Pro
  MISC_FEATURE (139)..(139): Absent or Gly
  MISC_FEATURE (140)..(140): Absent or Ser
  MISC_FEATURE (141)..(141): Absent or Pro
  MISC_FEATURE (142)..(142): Absent or Gln
  MISC_FEATURE (143)..(143): Absent or Val
  MISC_FEATURE (144)..(144): Absent or Val
  MISC_FEATURE (145)..(145): Absent or Trp
  MISC_FEATURE (146)..(146): Absent or Gln
  MISC_FEATURE (147)..(147): Absent or Asp
  MISC_FEATURE (148)..(148): Absent or Asn
  MISC_FEATURE (149)..(149): Absent or Ile
  MISC_FEATURE (150)..(150): Absent or Asp
  MISC_FEATURE (151)..(151): Absent or Pro
  MISC_FEATURE (152)..(152): Absent or Asp
  MISC_FEATURE (153)..(153): Absent or Asn
  MISC_FEATURE (154)..(154): Absent or Met
  MISC_FEATURE (155)..(155): Absent or Thr
  MISC_FEATURE (156)..(156): Absent or Tyr
  MISC_FEATURE (157)..(157): Absent or Glu
  MISC_FEATURE (158)..(158): Absent or Glu
  MISC_FEATURE (159)..(159): Absent or Leu
  MISC_FEATURE (160)..(160): Absent or Leu
  MISC_FEATURE (161)..(161): Absent or Asp
  MISC_FEATURE (162)..(162): Absent or Leu
  MISC_FEATURE (163)..(163): Absent or Gly
  MISC_FEATURE (164)..(164): Absent or Glu
  MISC_FEATURE (165)..(165): Absent or Ala
  MISC_FEATURE (166)..(166): Absent or Val
  MISC_FEATURE (167)..(167): Absent or Gly
  MISC_FEATURE (168)..(168): Absent or Thr
  MISC_FEATURE (169)..(169): Absent or Gln
  MISC_FEATURE (170)..(170): Absent or Ser
  MISC_FEATURE (171)..(171): Absent or Arg
  MISC_FEATURE (172)..(172): Absent or Gly
  MISC_FEATURE (173)..(173): Absent or Leu
  MISC_FEATURE (175)..(175): Absent or Glu or Gln
  MISC_FEATURE (177)..(177): Absent or Leu or Cys
  MISC_FEATURE (179)..(179): Absent or Leu or Ser
  MISC_FEATURE (180)..(180): Absent or Trp or Leu
  MISC_FEATURE (181)..(181): Absent or Ile or Leu
  MISC_FEATURE (182)..(182): Absent or Ser or Pro
  MISC_FEATURE (183)..(183): Absent or Tyr or Ile
  MISC_FEATURE (184)..(184): Absent or Pro or Thr
  MISC_FEATURE (185)..(185): Absent or Lys
  MISC_FEATURE (186)..(186): Absent or Tyr
  MISC_FEATURE (187)..(187): Absent or Lys
  MISC_FEATURE (188)..(188): Absent or Cys
  MISC_FEATURE (189)..(189): Absent or Gly
  MISC_FEATURE (190)..(190): Absent or Phe
  MISC_FEATURE (191)..(191): Absent or Phe
  MISC_FEATURE (192)..(192): Absent or Ser
  MISC_FEATURE (193)..(193): Absent or Arg
  MISC_FEATURE (194)..(194): Absent or Lys
  MISC_FEATURE (195)..(195): Absent or Lys
  MISC_FEATURE (196)..(196): Absent or Thr
  MISC_FEATURE (197)..(197): Absent or Arg
  MISC_FEATURE (198)..(198): Absent or Arg
  MISC_FEATURE (199)..(199): Absent or Glu
  MISC_FEATURE (200)..(200): Absent or Arg
  MISC_FEATURE (201)..(201): Absent or Cys
  MISC_FEATURE (202)..(202): Absent or Val
  MISC_FEATURE (203)..(203): Absent or Met or Ile
  MISC_FEATURE (204)..(204): Absent or Met or Cys
  MISC_FEATURE (205)..(205): Absent or Ser or Gln
  MISC_FEATURE (206)..(206): Absent or Thr or Met
  MISC_FEATURE (209)..(209): Absent or Gly or Arg
  MISC_FEATURE (210)..(210): Absent or Arg
  MISC_FEATURE (211)..(211): Absent or Gly
  MISC_FEATURE (212)..(212): Absent or Asn
  MISC_FEATURE (213)..(213): Absent or Leu
  MISC_FEATURE (214)..(214): Absent or Gln
  MISC_FEATURE (218)..(218): Absent or Pro
  MISC_FEATURE (219)..(219): Absent or Cys
  MISC_FEATURE (220)..(220): Absent or Lys
  MISC_FEATURE (222)..(222): Absent or Ile or Val
  MISC_FEATURE (223)..(223): Absent or Leu or Tyr
  MISC_FEATURE (224)..(224): Absent or Ser or His
  MISC_FEATURE (225)..(225): Absent or Ala
  MISC_FEATURE (226)..(226): Absent or Ser
  MISC_FEATURE (227)..(227): Absent or Cys
  MISC_FEATURE (228)..(228): Absent or Val
  MISC_FEATURE (229)..(229): Absent or Thr
  MISC_FEATURE (230)..(230): Absent or Arg
  MISC_FEATURE (231)..(231): Absent or Trp
  MISC_FEATURE (232)..(232): Absent or Leu
  MISC_FEATURE (233)..(233): Absent or Ser
  MISC_FEATURE (234)..(234): Absent or Ile
  MISC_FEATURE (235)..(235): Absent or Asn
  MISC_FEATURE (236)..(236): Absent or Lys
  MISC_FEATURE (237)..(237): Absent or Val
  MISC_FEATURE (238)..(238): Absent or Cys
  MISC_FEATURE (239)..(239): Absent or Pro
  MISC_FEATURE (240)..(240): Absent or Val
  MISC_FEATURE (241)..(241): Absent or Cys
  MISC_FEATURE (242)..(242): Absent or Phe
  MISC_FEATURE (243)..(243): Absent or Ala
  MISC_FEATURE (244)..(244): Absent or Glu
  MISC_FEATURE (245)..(245): Absent or Val
  MISC_FEATURE (248)..(248): Absent or Asn or Glu
  MISC_FEATURE (249)..(249): Absent or Asp
  MISC_FEATURE (250)..(250): Absent or Ser
  MISC_FEATURE (251)..(251): Absent or Leu
  MISC_FEATURE (252)..(252): Absent or Arg
  MISC_FEATURE (253)..(253): Absent or Gln
XXXXXXSSRQMELHYINTGFPYTITESFMDFFEGLTYAHADFALMDGFQDQGNPYWTMMHTNSYKYGYSGSGNYYSYAHAYDIDDYMHRTDGGRRTWDNTTPVNNVDSANVVLQXGEAPRTTANTTSEDCXXXXXXXXXXXXXXXXXXXXXXXXXXXXXXXXXXXXXXXXXXXSXEXIXXXXXXXXXXXXXXXXXXXXXXXXXXXXEYXXXXXXITLXXXHXXXXXXXXXXXXXXXXXXXXXXXXPGXXXXXX

What is claimed is:

1. A transgenic plant cell having recombinant DNA in its chromosomal DNA wherein said recombinant DNA comprises (a) a promoter that is functional in a plant cell and that is operably linked to a polynucleotide that encodes a protein having an amino acid sequence having at least 95% identity over at least 95% of the length of SEQ NO:13 and having trehalose phosphate synthase activity and (b) a promoter that is functional in a plant cell and that is operably linked to a polynucleotide that encodes a protein having an amino acid sequence having at least 95% identity over at least 95% of the length of SEQ ID NO:14 and having trehalose phosphatase activity.

2. A transgenic plant cell comprising the recombinant DNA of claim 1 wherein said plant cell is in a plant selected by screening a population of transgenic plants that have been transformed with said recombinant DNA for an enhanced trait as compared to control plants that do not comprise the recombinant DNA; and wherein said enhanced trait is increased yield.

3. The plant cell of claim 2 further comprising DNA expressing a protein that provides tolerance from exposure to an herbicide comprising an agent applied at levels that are lethal to a wild type of said plant cell.

4. The plant cell of claim 3 wherein the agent of said herbicide is a glyphosate, dicamba, or glufosinate compound.

5. A transgenic plant comprising a plurality of plant cells of claim 2.

6. The transgenic plant of claim 5 which is homozygous for said recombinant DNA.

7. A transgenic seed comprising a plurality of plant cells of claim 2.

8. The transgenic seed of claim 7 from a corn, soybean, cotton, canola, alfalfa, wheat, rice, sugarcane, or sugar beet plant.

9. Grain comprising transgenic seed identifiable by the recombinant DNA in the transgenic plant cell of claim 1.

10. Seed meal produced from transgenic seed identifiable by the recombinant DNA in the transgenic plant cell of claim 1.

11. A transgenic pollen grain comprising a haploid gamete of a plant cell nucleus having a chromosome comprising the recombinant DNA in the transgenic plant cell of claim 1.

12. A method for manufacturing non-natural, transgenic seed that can be used to produce a crop of transgenic plants with an enhanced trait resulting from expression of a stably-integrated, recombinant DNA, said method comprising:

(a) screening a population of plants for an enhanced trait, wherein plants in the population comprise the transgenic plant cell of claim 1, wherein individual plants in said population that have the recombinant DNA in the transgenic plant cell exhibit said trait at a level less than, the same as or greater than the level that said trait is exhibited in control plants which do not contain said recombinant DNA, wherein said enhanced trait is increased yield;

(b) selecting from said population one or more plants that exhibit said trait at a level greater than the level that said trait is exhibited in control plants, and (c) collecting seed from selected plant from step b.

13. The method of claim 12 wherein said method for manufacturing said transgenic seed further comprises:

(a) verifying that said recombinant DNA is stably integrated in said selected plants, and (b) analyzing tissue of said selected plant to determine the expression of a protein having the function of a protein having an amino acid sequence selected from the group consisting SEQ ID NO:13 and SEQ ID NO:14.

14. The method of claim 13 wherein said seed is corn, soybean, cotton, canola, alfalfa, wheat, rice, sugarcane, or sugar beet seed.

15. A method of producing hybrid corn seed, said method comprising:

(a) acquiring hybrid corn seed from an herbicide tolerant corn plant, wherein the chromosomal DNA of said corn seed comprises recombinant DNA comprising:

(i) a promoter that is functional in a plant cell operably linked to a polynucleotide that encodes a protein having an amino acid sequence having at least 95% identity over at least 95% of the length of SEQ ID NO: 13 and having trehalose phosphate synthase activity; and (ii) a promoter that is functional in a plant cell operably linked to a polynucleotide that encodes a protein having an amino acid sequence having at least 95% identity over at least 95% of the length of SEQ ID NO: 14 and having trehalose synthase activity;

(b) producing corn plants from said hybrid corn seed, wherein a fraction of the plants produced from said hybrid corn seed are homozygous for said recombinant DNA, a fraction of the plants produced from said hybrid corn seed are hemizygous for said recombinant DNA, and a fraction of the plants produced from said hybrid corn seed has none of said recombinant DNA;

(c) selecting corn plants which are homozygous and hemizygous for said recombinant DNA by treating with a herbicide;

(d) collecting seed from herbicide-treated-surviving corn plants and planting said seed to produce further progeny corn plants;

(e) repeating steps (c) and (d) at least once to produce an inbred corn line; and (f) crossing said inbred corn line with a second corn line to produce hybrid seed.

* * * * *